United States Patent 11,260,081 (ENGINEERED PARASITES FOR DELIVERING PROTEIN TO THE CENTRAL NERVOUS SYSTEM (CNS)) - sequence listing, part 5

SEQ ID NO: 4271 - DNA, 4073 bp, homo sapiens
attcctagggccgggcgcgggggcggggaggcctggaggatttaacccaggagagccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccagggtccatcttgctgggatgatgttttaattccaaaccggatgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatgaaataccaactatgcgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaatccttgctggagggaagagaggggatgaactcaagttttccacatcctgggacacctgtccctcttttcctaactgcctaagataacccatttcttccaaccatctgaggacagtcccgtcgtctcagaggccctgcaccggggagagactgggctctgcagcagccacatcagcattcacagcttcatgtggcttcactgtctgaaaatctaccgactccaacatggccccacggtgacaacagacctgtgacaggaagcccaaagctcacatagaaatggtggacagatcaaagtctctatagtaagggaaaaaaagagaggtggcaggcatgagccccctgcacccagtggctcgtgtccatactgagtccagaccctgatcaaggcctgacttagtgtcactggcagtcccactaaattacacttccttacactggcccgatgcgacaaatcaggtggctcccttctgtcacgtggagcacacagtgttttccatcatccatagctttcttcctgatggtgtttgcattattgcgccttcccaatctgcatgctgcgttgggcttgcggtgcctgaacaaggtttgctcccatgagctcaggcaccctaggatcccctgttagactattaggctgtccagcatggtctcctttcccttcttggtggtggtcttttccctttccagaatagaacagtgattcttaaaataagttagagcaggccgggcgcggtggctcatgcctgtaatcccagcactttgggaggccgaggtgggtggatcacgaggtcaggagttcaagaccagcctggccaagatgatgaaaccccgtctctattaaaaatacaaaaattagctgggcgtggtggcaggcacctgtaatcccagcttcctgggaggctgaggcaggagaatcacttgaacccggggggcagaggttgcagtgagccgagatcacgccactgaactccagcctgggcaacagagtgagactctgtctcaaaaaaaaaaaaaaaacaaaaacaaaaaagcaagatcatccactacacatgaacatgaatcacagtattatttgcaca

SEQ ID NO: 4272 - DNA, 2133 bp, homo sapiens
cgggccaatcgttagtcagagtgggcggagccgcccgcgggcacctgcgcgttaagagtgggccgcgtcgctgaggggtagcgatgcgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaactggaactccaaagacgtggggcctcatcgggatttggttggtgaattgggaacagctctccggaagaggaacatccgctatggactataccactcactcttagagtggttccatccactctatctacttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattgtaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctaccaaaaaaaaaaaaaaaaaa

SEQ ID NO: 4273 - DNA, 4110 bp, homo sapiens
gtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaacttaaaaaaaaaaaaaaaaa

SEQ ID NO: 4274 - DNA, 3604 bp, homo sapiens
gcatctcctcctccctctccccgggctcctactggcctgaggttgagggcggctgggggctcggggcaggctccgcggcgttcccctccccaccccggccctccgttcagccgcgctcctccggggctgcggttcctactgcgcgagctgccagtggattcgctcttttcctccgtccgtggcccgcctgggcggccttgttctttccgcagcagccagataaccttctgttcggtgatgaaattatcactaatggttttcattcctgtgaaagtgatgaggaggatagagcctcacatgcaagctctagtgactggactccaaggccacggataggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaacttaaaaaaaaaaaaaaaaa

SEQ ID NO: 4275 - DNA, 979 bp, homo sapiens
tgagtctgcgcagtgtggggctgagggaggccggacggcgcgcgtgcgtgctggcgtgcgttcattttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactaaaaaaaaaaaaaaaaaaa

SEQ ID NO: 4276 - DNA, 921 bp, homo sapiens
tgagtctgcgcagtgtggggctgagggaggccggacggcgcgcgtgcgtgctggcgtgcgttcattttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactaaaaaaaaaaaaaaaaaaa

SEQ ID NO: 4277 - DNA, 1563 bp, homo sapiens
gctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaataaaatcaaaaaaaaaa

SEQ ID NO: 4278 - DNA, 1665 bp, homo sapiens
gctcagcatttggggacgctctcagctctcggcgcacggcccagggtgaaaatgtttgccattaaactcacatgaagtaggaaatatttatatggatacaaaaggcacctgcatgggataatgtcaaatttcatagatactgctttgtgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaataaaatcaaaaaaa

SEQ ID NO: 4279 - DNA, 1632 bp, homo sapiens
gctcagcatttggggacgctctcagctctcggcgcacggcccaggtaagcggggcgcgccctgcccgcccgcgatgggccgccagctagcggggtgtggagacgctgggaagaaggcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaataaaatcaaaaaaa

SEQ ID NO: 4280 - DNA, 1644 bp, homo sapiens
gctcagcatttggggacgctctcagctctcggcgcacggcccaggttatcttgtagcatagcaacttcggatttcactctacccggagagtttcccgcttggttgaacacattggcctcaggaagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaataaaatcaaaaaaaaaa

SEQ ID NO: 4281 - DNA, 1294 bp, homo sapiens
gcatagaatgcagatgagcaaagtgagtgggagagggaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttctttaccattgtct

SEQ ID NO: 4282 - DNA, 3444 bp, homo sapiens
gtaggaatcgcagcgccagcggttgcaaggcccaagaagcccatcctgggaaggaaaatgcattggggaaccctgtgcggattcttgtggctttggccctatcttttctatgtccaagctgtgcccatccaaaaagtccaagatgacaccaaaaccctcatcaagacaattgtcaccaggatcaatgacatttcacacacgcagtcagtctcctccaaacagaaagtcaccggtttggacttcattcctgggctccaccccatcctgaccttatccaagatggaccagacactggcagtctaccaacagatcctcaccagtatgccttccagaaacgtgatccaaatatccaacgacctggagaacctccgggatcttcttcacgtgctggccttctctaagagctgccacttgccctgggccagtggcctggagaccttggacagcctggggggtgtcctggaagcttcaggctactccacagaggtggtggccctgagcaggctgcaggggtctctgcaggacatgctgtggcagctggacctcagccctgggtgctgaggccttgaaggtcactcttcctgcaaggactacgttaagggaaggaactctggcttccaggtatctccaggattgaagagcattgcatggacaccccttatccaggactctgtcaatttccctgactcctctaagccactcttccaaaggcataagaccctaagcctccttttgcttgaaaccaaagatatatacacaggatcctattctcaccaggaagggggtccacccagcaaagagtgggctgcatctgggattcccaccaaggtcttcagccatcaacaagagttgtcttgtcccctcttgacccatctccccctcactgaatgcctcaatgtgaccaggggtgatttcagagagggcagaggggtaggcagagcctttggatgaccagaacaaggttccctctgagaattccaaggagttccatgaagaccacatccacacacgcaggaactcccagcaacacaagctggaagcacatgtttatttattctgcattttattctggatggatttgaagcaaagcaccagcttctccaggctctttggggtcagccagggccaggggtctccctggagtgcagtttccaatcccatagatgggtctggctgagctgaacccattttgagtgactcgagggttgggttcatctgagcaagagctggcaaaggtggctctccagttagttctctcgtaactggtttcatttctactgtgactgatgttacatcacagtgtttgcaatggtgttgccctgagtggatctccaaggaccaggttattttaaaaagatttgttttgtcaagtgtcatatgtaggtgtctgcacccaggggtggggaatgtttgggcagaagggagaaggatctagaatgtgttttctgaataacatttgtgtggtgggttctttggaaggagtgagatcattttcttatcttctgcaattgcttaggatgtttttcatgaaaatagctctttcaggggggttgtgaggcctggccaggcaccccctggagagaagtttctggccctggctgaccccaaagagcctggagaagctgatgctttgcttcaaatccatccagaataaaacgcaaagggctgaaagccatttgttggggcagtggtaagctctggctttctccgactgctagggagtggtctttcctatcatggagtgacggtcccacactggtgactgcgatcttcagagcaggggtccttggtgtgaccctctgaatggtccagggttgatcacactctgggtttattacatggcagtgttcctatttggggcttgcatgccaaattgtagttcttgtctgattggctcacccaagcaaggccaaaattaccaaaaatcttggggggtttttactccagtggtgaagaaaactcctttagcaggtggtcctgagacctgacaagcactgctaggcgagtgccaggactccccaggccaggccaccaggatggcccttcccactggaggtcacattcaggaagatgaaagaggaggtttggggtctgccaccatcctgctgctgtgtttttgctatcacacagtgggtggtggatctgtccaaggaaacttgaatcaaagcagttaactttaagactgagcacctgcttcatgctcagccctgactggtgctataggctggagaagctcacccaataaacattaagattgaggcctgccctcagggatcttgcattcccagtggtcaaaccgcactcacccatgtgccaaggtggggtatttaccacagcagctgaacagccaaatgcatggtgcagttgacagcaggtgggaaatggtatgagctgaggggggccgtgcccaggggcccacagggaaccctgcttgcactttgtaacatgtttacttttcagggcatcttagcttctattatagccacatccctttgaaacaagataactgagaatttaaaaataagaaaatacataagaccataacagccaacaggtggcaggaccaggactatagcccaggtcctctgatacccagagcattacgtgagccaggtaatgagggactggaaccagggagaccgagcgctttctggaaaagaggagtttcgaggtagagtttgaaggaggtgagggatgtgaattgcctgcagagagaagcctgttttgttggaaggtttggtgtgtggagatgcagaggtaaaagtgtgagcagtgagttacagcgagaggcagagaaagaagagacaggagggcaagggccatgctgaagggaccttgaagggtaaagaagtttgatattaaaggagttaagagtagcaagttctagagaagaggctggtgctgtggccagggtgagagctgctctggaaaatgtgacccagatcctcacaaccacctaatcaggctgaggtgtcttaagccttttgctcacaaaacctggcacaatggctaattcccagagtgtgaaacttcctaagtataaatggttgtctgtttttgtaacttaaaaaaaaaaaaaaaagtttggccgggtgcggtggctcacgcctgtaatcccagcactttgggaggccaaggtggggggatcacaaggtcactagatggcgagcatcctggccaacatggtgaaaccccgtctctactaaaaacacaaaagttagctgagcgtggtggcgggcgcctgtagtcccagccactcgggaggctgagacaggagaatcgcttaaacctgggaggcggagagtacagtgagccaagatcgcgccactgcactccggcctgatgacagagcgagattccgtcttaaaaaaaaaaaaaaaaaagtttgtttttaaaaaaatctaaataaaataactttgccccctgcaaaaaaaaaaaaaaaaa

SEQ ID NO: 4283 - DNA, 3203 bp, homo sapiens
ggacaaactgttccagatgggagttggagaaagccttgctatggatgtgacatttgggctgagatgtggatgatgagaaggagtcaggcagccgtgccctggaggagatagcgatgcagacagcagaagccctgaggacagagccagctgacagcccatgtggtgccagaggggagaactggagaagttaaatcagtccacggatgatatcaacagacgggagactgaacttgaggtccagtaggtgtttgcagatcccttcttaagcctcaactgtgtttcctcggtttcccctggctgcaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaagtttctcctttctgtgacttcaaataagaactcccagtattgcctaaatcttctaggcaaccctttttccataaggaagagcatggagtgctgtggtcaccagtaatcattttcaattaattaaggtcatgaacagtaataatttaagccttgtttaccaaggtttgaattctacttttgctgttgctaaagctgtgggcaatgaggagacacagtggcagataaagacgaggtggtgacgctggaggagtgggcctcggctgcacactgcagtctcgaagcttaagtgttgctgtcagtcagttctcatccccagagaattatttaattaattaactggggggggtacactggggcattagacttttaaaagctccccgagggaattcaaatgtgcattcagagttgagaatcagatggattctttcttttgtggaaatgttttataatattggactcttaatccgcatttcattattaaagcatgctgtggagaaaaa

SEQ ID NO: 4284 - DNA, 3322 bp, homo sapiens
gcgctgactgccgcggcagaaagggggcggccgcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaagtttctcctttctgtgacttcaaataagaactcccagtattgcctaaatcttctaggcaaccctttttccataaggaagagcatggagtgctgtggtcaccagtaatcattttcaattaattaaggtcatgaacagtaataatttaagccttgtttaccaaggtttgaattctacttttgctgttgctaaagctgtgggcaatgaggagacacagtggcagataaagacgaggtggtgacgctggaggagtgggcctcggctgcacactgcagtctcgaagcttaagtgttgctgtcagtcagttctcatccccagagaattatttaattaattaactggggggggtacactggggcattagacttttaaaagctccccgagggaattcaaatgtgcattcagagttgagaatcagatggattctttcttttgtggaaatgttttataatattggactcttaatccgcatttcattattaaagcatgctgtggagaaaaa

SEQ ID NO: 4285 - DNA, 5735 bp, homo sapiens
gtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaatctttgttttctcttattctaggtaaggcatattaaaaataaatatgtaaagaagaaaaataaaagttgtcttcatggaagcaacttgtcttccttggttgtactgagttacagttatcctaggggtgaaacatgtgatgctgctaagcaaaccaaatgccctcagaacaggtgttatgtggggcatactattgtttgcttttgttgagaatcaggtggttaatttttgactgttcttgatttctaatgctgaaatgacatgattctgttattcagcaaacttggaaatcttgatgttttgacaactgcctcctaggaaaactggccatatgttaattaacctagtagatggaaaattaaggattatgtgaggttaattttaccctgataatgacaaaaccttgatagcatttaatattaatacttcttctcaaaattgaatgtttatatcaagtactgatttttattttaaaaaagaaaaaactataatccttctgccttccaaaagccatgctgtgatagctgcccaggctgctctgttacatctcccatttattgtttacttttataaatttgcttctaagatggaaaaaaaaaa

SEQ ID NO: 4286 - DNA, 1914 bp, homo sapiens
agagtcacatctcttatttggaccagtatagacagaagtaaacccagctgacttgtttcctgggacagttgagttaagggatggctttcacagagcattcaccgctgacccctcaccgtcgggacctctgtagccgctctatctggctagcaaggaagattcgttcagacctgactgctcttacggaatcctatgtgaagcatcagggcctgaacaagaacatcaacctggactctgcggatgggatgccagtggcaagcactgatcagtggagtgagctgaccgaggcagagcgactccaagagaaccttcaagcttatcgtaccttccatgttttgttggccaggctcttagaagaccagcaggtgcattttaccccaaccgaaggtgacttccatcaagctatacatacccttcttctccaagtcgctgcctttgcataccagatagaggagttaatgatactcctggaatacaagatcccccgcaatgaggctgatgggatgcctattaatgttggagatggtggtctctttgagaagaagctgtggggcctaaaggtgctgcaggagctttcacagtggacagtaaggtccatccatgaccttcgtttcatttcttctcatcagactgggatcccagcacgtgggagccattatattgctaacaacaagaaaatgtagcagttagtcccttctctcttccttgctttctcttctaatggaatatgcgtagttccctggggcctcgctttcccatcttaaatttctaaaaacagttaagacaacaggcattttctttcttttttctctgaccacctgcagcctgttgaaggactacaggtattttcatcaagtagcgttggagacatacacaaatgggcatacaagtttagcctggggggtgtgatttgtgtgcgtgcttgcatgtgctgcaggtgtaagagagtgggagcagggacaacgtccttccacttcagggttctaacctttctaacccactaagtaacctctacaggcatttaactgccttacagacagaatatacatatgttaattctagtcctggatgactcggtctgagaagattcaatttaaaatcagactctttagttgatttaaactcttagagaataagaataataatggctaacttttattatcttctatattaaggcagtatgccaagggtctttatgtatattatgtacagcgtttacaaccttgtgagcaaggtggtgttactcccattaggtagatgagaaaacaggctcacagagatttggttaagctcacacagctaacaagtagcacactgagtttgaacacagatcattctccttgtaaaagcctatgtgcctttcactttagaggcttgatcatgaatcactgcacctctttgtcacagggtgttggaagatgcatccatgtaatctattcccatcgctggaaaacagctgctgttagatgtcctcagaagtcagttgcaaattttagcgttaaagtcaggatttattgttcatacttggcggtgaggagggcagctggagatcttaagattccattttggaaaatgattaggcccgccaaacttctgaactttggaagctggggatgtttagtaatacagcctggtttttaagtactcactaaaagttctcaaatattgggttgggcacggcttataccaggttacctcacttttaattagtgatgcaggcagtgtaacccaagcatttgtggacaatgagtggaatactaaagttaaaaagtcaaactttcacctcagattttctggacttagtcatgaggagagggtgaggcccactctgttcctactggagataccagagactctgaaactatagaataaagcctctgtgctgcacaacaaaaaaaaaaaaaaaaaaaaaaa

SEQ ID NO: 4287 - DNA, 1418 bp, homo sapiens
aaacaataacgtcattatttaataagtcatcggtgattggtccgcccctgaggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgtttattttattgcc

SEQ ID NO: 4288 - DNA, 11956 bp, homo sapiens
ctgctcagtgtcaaattaacaggaaagtcagcttaaaggacactccttgcagggactgagctggcacctactccttagagcttgctgataccaggcctgccacgcgacatctgcaaggacagttgtttggtgttttgcttcaggttatagatggagagacctataaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaagacacagacaaataaaaagccagattttccactcgatattaatacccacataaacctgtgtgtttgcaaacgtgtacatgtacacacatacacatcccacgttcgcttcaggtcctttcttatttgagcttaatccaaataaaaagggacttgacaccttaccctgcatacaataggcaccccttacatgtgttttgagttggtctgaatctgaacatggggtgctttcagttcaggtagttagctagttctggccacattctgagtttcactgaagatgtggatcccttcagacataatgcacattgctttgtcctggatatgcaccttgcttgatttgaaatggatgccaagccaaaattgttggcattcaggagggataagcaggcttctaaaaataacagcatctgcagagttttcttcttccatccaaacaagttgtgtttcgatggtccacatgaccaggtgtatgtctgtaagtgtggagggagaggacaagaaattgtgcatgtgtgtgcagacatgcacaaacaggagcaatccaataacaccttagtgaatagaaatatggttggggatttgctgagctgtatttatccagcaacaggtttccagccccagatgttagtagtgcaaaagggccaagtgcctcaattgtgagcctctgagctaggaggagaagtgatgaagagtggcctatgtggtcccttctacctgaccttaagtcatctcaaaatgaaatattgtgagaatgaagggaacccttagggaaccttgtgggtaaggtaagtggacatggatttgtcagtagcctgttcctactgtgccatgttaatcttggtgcgaaaaactattccaatacatctcaaactccaagagacttcagaaacatcaagatttagtgtaatgagcggcgcagaaaaatgttttcattgctccataatctgaccacacgtaacatttgtgacgtgaaaaccatgactttctcattctgaggtctttggtttctgcctgtgggaaattgaatggcactgtatggactatttcatctgttgatggtaaaacaaaagggtgatttttttgcttgtggttgtcatcttgggtttacctttgtaagaagacatcatcaccattctgaaggcagtggcttggcatggagatttttattctgtagcactgggcctgttcttctaaggacagcacaaggtagacaattgtagagccaaggccactttttcaggaagatctagtctcttgctaaccctcttctttctctcttgctattgctgctgctcttttgatggtttatagtcttaatggcctgccttgataattcctttgaacactttcattagttgttttgcataccagagatgccgcacctgctgttggcttatttttttacttgttctattaactgttgattatctgaatgtttcccctcctccttgtttcatgtcccaagaatggtgctcctgttttcagtgacagttcagctgaacatataagcagatgtgtaaacagatgaagtaaccatgcagtttccttgtggcattagttccatttcacaaagtgaagaccactggtgggctgatctgagtgtgccaatcctgatcatttaaacctacagccttcaactggtgattcctacccaccgttttcattctgctataaccctgtgatatgtgtgcgtgtgggtgtgagtgtgggtgtgtgcacatatagagatttagtcttaatttcaaccaaatgacatgcaagattccactgccactcttcctggccaaaagtgtgcacagactgtgatttattcattgtggtctgtgactttaacccatcattgatgctctcacttaggtaaaccctaaagaccaaactagcaacactagtcaagggagtgactggagttatttctggtagcagtagccactggcatcctagaaacacatggacatttgtagcatgaattgacctattggtagtgcaatagctatacatgatttttattcttggcaaaagaaaatgcttcaaaaaaaaagtgatcaaacctgcacattgatcctgtaatagcaaatggaaggctatttctctgtactagcatttcagctttatgtgggaaagttacccgttctcctgcaagtacaatcaacccttgatgacttaagtattaattattctgggtgtagctcacccaagttttcttcctacatcttttggctaattccaccacacctcagcatcacagtcagatgggaaaaggggcaggtggattctcatgtcatgccttcttgtaccttattttcaagttttgtggtggaggaggtttaattatctgctcaagaatctggtatatatagccaggtgcggtggctcatgcctgtaatcccaggactttgggcaaggcgagaggatcacctgaggtcaggagttcaagaccagcctggccaacatggcaaaaccccatctctactaaaaatacaaaaattagctgggtttggtggtggacacctgtagtcccagctacttgggaggctgcggcaggagaatcacttgaaccccggaagtggaggttgcagtgagccaagatcgtgccattgcactccagcttgggtgaccgagcaagactccgtctcaaaaaaaaaaaaaaaatcggctatatgtaaaaactattaattatgtaacctcactccaatactgtactgatcaagatctgcccactcctagaggactgacccaatggcagatcccctactataatctttctgacaactcagtgacaggtaaaatcactctaatattcctaaaatatctagacacttgaattagaaatacagaaccacccccacccctgccattgcttaagccatattaaagcttcatgtactgtaaagtcagggatgtactgtgatactttaagaccactaatctcagtggaatttcaggacatagcattagttggtaaattacaccagactaggggctcactcctccttagattgaagtccaaataaaagtcttcacctttggatcaaaggccacatatatatgatcatcatcaataaattgtcataaagtgtctatgaactgctcttgccatcttcctaatacgtaacttcatgacatcatgtctctagaagtgcttaatacaatccaaaagaacaaggggggaaggccccaagtcaccactgaccgacctcagcaggggccagtggtagaacaacaatcttgtgaattaggagacatagaaaatgtacgcaaaagtaaattccaagcgctgagcatgtacaagctatttttattattaaaagccaagaaggaagagcattgaagaagtaatgattttaatatagtgggggatttcccccttaaatttttataatttccttgtgaataaacaatcatggaaaagaagaaacctagtcatacaaaatcagaataaataaaaatcttaagactggatccacatctttggccaattcatataagcacctaatacatcaatttctctgtacttaaaatgaagagaataattaatattcttaagtacaatgttttcaatagagaacaaatgaaatcacctttgtcatcaacagcagcccagactgactgtatctagatcacaccttgatgttacgtttgaatgcagtcagtagttaccaaaaagtaattagtgcacattaaatagtggtaaaatcagcagggagaaatatgggattagcacgtagttccagaaccttcctcctcctccagagtgcaactcaacaaacagtacactccaaattaagaatcaatgtttcatcccaggacaaacggtgttgctcccatcacagtaccacaactgagatactgtgaagtcattgcactaccagtaggttactactcttttgaagttactgtttttaaatcctaaaatatgtccccagttttctacattcattcttcttcccctaagagttgctagaagcagatgaaggatccctattgactctgcagggtttgatttcagtaccttagacagctatctggtgacttcccagtaggcacgaacaaccccttctctccccttgcagtcggtgggcttgatgacgccccagacagtatcctttccttctctactgccgccaaaataaacattagggaaatgggatcattaacaccactgagaaaggagtttacagggatcgcaatagtaactgtctgcttgtggtagtagaaagcttgtgccaggctgcatgaatagaaattaatgttaaactcctgttagacgagtaatatgtagatttttattgaaacagaccacagcttattaaaaagtactcagtgcaatggtatatacatatatacagatagaaaaaaatataactgtgatctttttgtcttacgccattactggaaacacccaaacgtgaactggagttccctctgaacaaaaccattgtcaaatcttcaacatatgacctccaaatctaggtgccaagtgccctgtgacagttgtttacacacctgaaaaatgtatcctggaagctgtaatcttgggcctgggctatgtgttgaaacaagcaaaagagacacatcgtgaccaaccaagctggtggaggaaaagcacaaaattcaactccaacctgcagttaggatcccaaagagatgttgacatttatagccaaaaagaaaaagtacatatatatatatatatatatatatatatatatatatatatatatatatctgaatcagatcgaagcagccaacgtccagcttcactcaagaaggacaaggaataaacaacattctctagctgtgtcatgttgtctcagtttttgaatctcaaccaggactgatccaccttcatcagatacgttttttaatggcgcaacaactcaattttggtcccagactctccattctgcactggccacgagaacaacaagagaatgacaggatgttaatggaggaaacattttcatggcaagctcagaaactgaagtgtttatattcagaatcagatgagctttaatatgaatttgcatcttgcctctgtactgcttgctattttttaatgataggagaaagcataacagtttattttaaatatgaaatatattgatatattataaaatatattgtaactttcaattaacattttgtatcaaactagtgtttagcaggtccactgtcagcctgctctcccaatgactgtttctgagtacacatcactgttagtgattgccgggcacccagaaaaagggtcctcctaccacagcctactgaactgccatattctaattctccaaggcctgggtattagagacaaaagaacattattccaagagtagaggaataattctaccctaaattctatcaagccatttcagaagagattttaaaagccatcactcctttagtagctctgcaaagccagtttaataaaagttcaggctctttctatataaattcaaaggcctcattacataaattatataagtctcaaacctagccaaccagttttcctttgacaatgtcagaattggacataagaaagagtcctgttttcctgtaacttaaaatactcaaaatcctaggcattctgagtttctccatgtacgtgaaaccggggtcggctttccaaactacacaaggcccaacaagagtccagtgtgcagatgtgcttttctaaattggcaatacccttgagggagcaaggttcccacatgtttatcaaggacatggagcccagctcctaagggagtgatgggaggagccggcaggacatgaacagccagagccagcaaagagccgggctgccttttctgctagcttcctctagctgggaggaaataaagggttcccgttgagatattgtcctttatagcaaaattaagcaactcatggaatctacacccctctttctctacagagcagctgagacatacatgtagaagttctcagttccctccttcatatggctaaggcactacttctagatgaaaacaggatgtgttcggttacagaataaagattttctagaatcagtgagcctcttctcacctgggaccctcacttgctgttgttgctttggtgcaatattgtacaggtgcaaaccaggttgcatcggggcagattaactgagcctatgtgtctcttcccttcccaagccctgaaaattcacatagatttacagatagtgcaaaacaacaagttttctcctgggaaaaggctggaatccttcaaatttcaatttatatgagcttaaaggtatataagtcatggggctcactgacattaggtattcatgctgtttgaaagagaaatgtctaaatgcccgttttcagtctgtttgtgtagctgagccctaacttgtacacaagttttcttgttatggagctaaattctctcagtgcctgtattactcctcagttatatgttaggccgagctccactaaagccatctgaactccagggcacttgtttttatcaggttacttactcaccggataatggaaattggcttattttcaattttacaattgactgatgaatgtattggtggtaattgatttatttcttcacttttttttgctactaaatgattttttcttttttaaaattattattattattattttgagatggagtctcactctgtcgcccaggctggagtgcagtggcgccatctcagctcactgcaagctctgcctcctgggttcatgcaattctcctgcctcagcctcccgagtagctgggattacaggtgcgtgccaccacgaccagctaatttttttgtatttttagtagagacagggtttcatcatgttaaccaggatggtctcgatctcctgacctcgtgatccacctgcctgggcctcccaaagtgagccactgtgcctggcccagtaagtgcttttttcttttggtttttccttctaacactgctcagaccaagacttacatttataaagagcaaatatattctgacctttcccctcaaagttgtattccatctagaatcaaggaaacaaatgcaaattcatcatttggggaaagcagacctcttgacagtaattcaagtccatggctatatgctaacccttgctactcaaagtgtggtccacagaccagcagcgttagcatcatctgtaagcttgttagaaatgcagaatctcaggccccacatcaaaccttcttcatcagaattggccttttaacaaatccccaggtgacctgtatgcaccagaaatattgataagcactggcctcacctcaccgtagtgataactaacctcgttaataattagagaatgaagctatctcttccttgagtctcatttacagaattatttgaagatgtgaaggtcctgaatgatcataaggattaaaaaaatgcatctttaaattccacttgaggttatataacttggatggtctacatcaaacataataaagtcaataagagatagtctttttccggtcttacctaaatagcactccatatccttgagccacctcaaagcccccatttttaagttttagtctttttttttttagaccagactagcaaagccatcagaatatcaggtggaacctcagggcaggtcctctggaaggctacaggagtctctgcttagcatagtacagaaattgttgtgtttctcgatccttgtgttcttcccttgaggaactcagcatctcaccagtaagaactcccctcccctagaggaaaatagcaagagaagttagtttaaccatctagaaacattgctaatctccttgaaagccaattctcttactcattgcaccaacaagaaacactccaaggtgggcaaggaaagacgtgaattctgatattggcgccataactcgatatgtacccagaaacagttatgttctaaattaatggctttaacctgttcattgtaaaaagtgccttggacttcaatctaaagaggtcagtataaatatgtatgtgtgtgtgtgacgtgtatgtaggcaaatatttacagatttatacatacataggtgcacacacatatacccgcacattcatatataatatatacatacatatataaatgcttcataatatatcatattgctattcacagctccatttcttttgtctggtcctatgtttatttgtttagtgagacctttacatagagaggttctattcggaacattgatgtattttttgtttgttttttactttttattaaaaaggtaaaggatattaaaaaaaaaaaaaaaagtcaagtgcctgaaggttttgaatggagttacggtaaactttctcaggtcaccaaagaggaaacatttttcctttggaaaacatttttctgtttcagtgactttgttttcccttggtggtaatgcataaataagagtggttaaagtgattttgtaagttttatttcaatccatttctgtggttcccataaggcaatagctaaaaatttgttcagtctagtgcccagttttctccacacatcagcatcagaagggcccggtcttcacatgctctgtgtggttttgttcgcgttgttactgtgttccttactaaggaaaggcaaatgaaattgcaggggctggagcttagaccagctccaaatatggcttccttttggtaacacacacagaaggtggactagtgggaagtctctctccctgaagcaggtgggaacctgtgtcttagaaggcagaggagtcccagtgaactctccacagctccatgggccctgcctgtctacagttatacaactgcctgtatgagtcagcctttctctaccttagccaaaggtcttctctttctgtggtgtgacagcttgtaatgaaccaacttgctctggttagaagtccctagagctccaggaagagtcgccaggtttccattgctgtgctcaaagctcaaggacacattatacttctttaaaccaactaaatctctctagctccctgcccccatggtgacactttcataataggcagggccaagtcagagaggtcatgccctgtatacagtgtcaatcagaagagacactgcaaaatgtcagaggtgaccagaaagacaacagatctctccagctgtcctcacagctgcaggcacatttgtggaattgtgagtaggaaggcttggcagccaggggatgggaaatgaatttccccaagttgaaaaccctgtacccttactttccttcccataaatttttctgtagttctaggtaaataataataataataaaaatgcaaattaggtgctttagaaggagtatgtaatatctgggactttttctaagttggtagacctaaaaaatgttttcaaaaatatatctagctgcatttctactgctgtcattccttaaagctcttcctccaaaaactccatatgaatgaatacatttaccaactcagtgattactaaataatagtactttatacttatacacagtaatacctttcatctaaggatctcaaatgccaatatattagtcatcaccctgtaaggtggatgacatattattcccattattccaatgggaaaattgggccatagaaaactgaggagcaaatgactcatctacaggaattaaatggaaaaaacaggctaggatttctcagcacactttaggagtgaatgaaaacttacaggcttcagttctactgctggccaccattggatttgtaagatccaggatgtgtattgaccacatgtgtccagacccaggcttagggcatctggaatgagagtggtgggctggtgtgtgggtctgaggatctggatgggagactgcattttcttctctgtgcaaaatatggaagtgtgaccttgaaggtgggcttagtctatggccttccccactcctgcttgaactgaagctggagagaatgggcatttttaaatgttacggcatatgctaatataatattatggcattaaataaaaacaagaagagaactgactaaaaccaaaaaaaaaaaaaaaaa

SEQ ID NO: 4289 - DNA, 13035 bp, homo sapiens
gagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaagacacagacaaataaaaagccagattttccactcgatattaatacccacataaacctgtgtgtttgcaaacgtgtacatgtacacacatacacatcccacgttcgcttcaggtcctttcttatttgagcttaatccaaataaaaagggacttgacaccttaccctgcatacaataggcaccccttacatgtgttttgagttggtctgaatctgaacatggggtgctttcagttcaggtagttagctagttctggccacattctgagtttcactgaagatgtggatcccttcagacataatgcacattgctttgtcctggatatgcaccttgcttgatttgaaatggatgccaagccaaaattgttggcattcaggagggataagcaggcttctaaaaataacagcatctgcagagttttcttcttccatccaaacaagttgtgtttcgatggtccacatgaccaggtgtatgtctgtaagtgtggagggagaggacaagaaattgtgcatgtgtgtgcagacatgcacaaacaggagcaatccaataacaccttagtgaatagaaatatggttggggatttgctgagctgtatttatccagcaacaggtttccagccccagatgttagtagtgcaaaagggccaagtgcctcaattgtgagcctctgagctaggaggagaagtgatgaagagtggcctatgtggtcccttctacctgaccttaagtcatctcaaaatgaaatattgtgagaatgaagggaacccttagggaaccttgtgggtaaggtaagtggacatggatttgtcagtagcctgttcctactgtgccatgttaatcttggtgcgaaaaactattccaatacatctcaaactccaagagacttcagaaacatcaagatttagtgtaatgagcggcgcagaaaaatgttttcattgctccataatctgaccacacgtaacatttgtgacgtgaaaaccatgactttctcattctgaggtctttggtttctgcctgtgggaaattgaatggcactgtatggactatttcatctgttgatggtaaaacaaaagggtgatttttttgcttgtggttgtcatcttgggtttacctttgtaagaagacatcatcaccattctgaaggcagtggcttggcatggagatttttattctgtagcactgggcctgttcttctaaggacagcacaaggtagacaattgtagagccaaggccactttttcaggaagatctagtctcttgctaaccctcttctttctctcttgctattgctgctgctcttttgatggtttatagtcttaatggcctgccttgataattcctttgaacactttcattagttgttttgcataccagagatgccgcacctgctgttggcttatttttttacttgttctattaactgttgattatctgaatgtttcccctcctccttgtttcatgtcccaagaatggtgctcctgttttcagtgacagttcagctgaacatataagcagatgtgtaaacagatgaagtaaccatgcagtttccttgtggcattagttccatttcacaaagtgaagaccactggtgggctgatctgagtgtgccaatcctgatcatttaaacctacagccttcaactggtgattcctacccaccgttttcattctgctataaccctgtgatatgtgtgcgtgtgggtgtgagtgtgggtgtgtgcacatatagagatttagtcttaatttcaaccaaatgacatgcaagattccactgccactcttcctggccaaaagtgtgcacagactgtgatttattcattgtggtctgtgactttaacccatcattgatgctctcacttaggtaaaccctaaagaccaaactagcaacactagtcaagggagtgactggagttatttctggtagcagtagccactggcatcctagaaacacatggacatttgtagcatgaattgacctattggtagtgcaatagctatacatgatttttattcttggcaaaagaaaatgcttcaaaaaaaaagtgatcaaacctgcacattgatcctgtaatagcaaatggaaggctatttctctgtactagcatttcagctttatgtgggaaagttacccgttctcctgcaagtacaatcaacccttgatgacttaagtattaattattctgggtgtagctcacccaagttttcttcctacatcttttggctaattccaccacacctcagcatcacagtcagatgggaaaaggggcaggtggattctcatgtcatgccttcttgtaccttattttcaagttttgtggtggaggaggtttaattatctgctcaagaatctggtatatatagccaggtgcggtggctcatgcctgtaatcccaggactttgggcaaggcgagaggatcacctgaggtcaggagttcaagaccagcctggccaacatggcaaaaccccatctctactaaaaatacaaaaattagctgggtttggtggtggacacctgtagtcccagctacttgggaggctgcggcaggagaatcacttgaaccccggaagtggaggttgcagtgagccaagatcgtgccattgcactccagcttgggtgaccgagcaagactccgtctcaaaaaaaaaaaaaaaatcggctatatgtaaaaactattaattatgtaacctcactccaatactgtactgatcaagatctgcccactcctagaggactgacccaatggcagatcccctactataatctttctgacaactcagtgacaggtaaaatcactctaatattcctaaaatatctagacacttgaattagaaatacagaaccacccccacccctgccattgcttaagccatattaaagcttcatgtactgtaaagtcagggatgtactgtgatactttaagaccactaatctcagtggaatttcaggacatagcattagttggtaaattacaccagactaggggctcactcctccttagattgaagtccaaataaaagtcttcacctttggatcaaaggccacatatatatgatcatcatcaataaattgtcataaagtgtctatgaactgctcttgccatcttcctaatacgtaacttcatgacatcatgtctctagaagtgcttaatacaatccaaaagaacaaggggggaaggccccaagtcaccactgaccgacctcagcaggggccagtggtagaacaacaatcttgtgaattaggagacatagaaaatgtacgcaaaagtaaattccaagcgctgagcatgtacaagctatttttattattaaaagccaagaaggaagagcattgaagaagtaatgattttaatatagtgggggatttcccccttaaatttttataatttccttgtgaataaacaatcatggaaaagaagaaacctagtcatacaaaatcagaataaataaaaatcttaagactggatccacatctttggccaattcatataagcacctaatacatcaatttctctgtacttaaaatgaagagaataattaatattcttaagtacaatgttttcaatagagaacaaatgaaatcacctttgtcatcaacagcagcccagactgactgtatctagatcacaccttgatgttacgtttgaatgcagtcagtagttaccaaaaagtaattagtgcacattaaatagtggtaaaatcagcagggagaaatatgggattagcacgtagttccagaaccttcctcctcctccagagtgcaactcaacaaacagtacactccaaattaagaatcaatgtttcatcccaggacaaacggtgttgctcccatcacagtaccacaactgagatactgtgaagtcattgcactaccagtaggttactactcttttgaagttactgtttttaaatcctaaaatatgtccccagttttctacattcattcttcttcccctaagagttgctagaagcagatgaaggatccctattgactctgcagggtttgatttcagtaccttagacagctatctggtgacttcccagtaggcacgaacaaccccttctctccccttgcagtcggtgggcttgatgacgccccagacagtatcctttccttctctactgccgccaaaataaacattagggaaatgggatcattaacaccactgagaaaggagtttacagggatcgcaatagtaactgtctgcttgtggtagtagaaagcttgtgccaggctgcatgaatagaaattaatgttaaactcctgttagacgagtaatatgtagatttttattgaaacagaccacagcttattaaaaagtactcagtgcaatggtatatacatatatacagatagaaaaaaatataactgtgatctttttgtcttacgccattactggaaacacccaaacgtgaactggagttccctctgaacaaaaccattgtcaaatcttcaacatatgacctccaaatctaggtgccaagtgccctgtgacagttgtttacacacctgaaaaatgtatcctggaagctgtaatcttgggcctgggctatgtgttgaaacaagcaaaagagacacatcgtgaccaaccaagctggtggaggaaaagcacaaaattcaactccaacctgcagttaggatcccaaagagatgttgacatttatagccaaaaagaaaaagtacatatatatatatatatatatatatatatatatatatatatatatatatctgaatcagatcgaagcagccaacgtccagcttcactcaagaaggacaaggaataaacaacattctctagctgtgtcatgttgtctcagtttttgaatctcaaccaggactgatccaccttcatcagatacgttttttaatggcgcaacaactcaattttggtcccagactctccattctgcactggccacgagaacaacaagagaatgacaggatgttaatggaggaaacattttcatggcaagctcagaaactgaagtgtttatattcagaatcagatgagctttaatatgaatttgcatcttgcctctgtactgcttgctattttttaatgataggagaaagcataacagtttattttaaatatgaaatatattgatatattataaaatatattgtaactttcaattaacattttgtatcaaactagtgtttagcaggtccactgtcagcctgctctcccaatgactgtttctgagtacacatcactgttagtgattgccgggcacccagaaaaagggtcctcctaccacagcctactgaactgccatattctaattctccaaggcctgggtattagagacaaaagaacattattccaagagtagaggaataattctaccctaaattctatcaagccatttcagaagagattttaaaagccatcactcctttagtagctctgcaaagccagtttaataaaagttcaggctctttctatataaattcaaaggcctcattacataaattatataagtctcaaacctagccaaccagttttcctttgacaatgtcagaattggacataagaaagagtcctgttttcctgtaacttaaaatactcaaaatcctaggcattctgagtttctccatgtacgtgaaaccggggtcggctttccaaactacacaaggcccaacaagagtccagtgtgcagatgtgcttttctaaattggcaatacccttgagggagcaaggttcccacatgtttatcaaggacatggagcccagctcctaagggagtgatgggaggagccggcaggacatgaacagccagagccagcaaagagccgggctgccttttctgctagcttcctctagctgggaggaaataaagggttcccgttgagatattgtcctttatagcaaaattaagcaactcatggaatctacacccctctttctctacagagcagctgagacatacatgtagaagttctcagttccctccttcatatggctaaggcactacttctagatgaaaacaggatgtgttcggttacagaataaagattttctagaatcagtgagcctcttctcacctgggaccctcacttgctgttgttgctttggtgcaatattgtacaggtgcaaaccaggttgcatcggggcagattaactgagcctatgtgtctcttcccttcccaagccctgaaaattcacatagatttacagatagtgcaaaacaacaagttttctcctgggaaaaggctggaatccttcaaatttcaatttatatgagcttaaaggtatataagtcatggggctcactgacattaggtattcatgctgtttgaaagagaaatgtctaaatgcccgttttcagtctgtttgtgtagctgagccctaacttgtacacaagttttcttgttatggagctaaattctctcagtgcctgtattactcctcagttatatgttaggccgagctccactaaagccatctgaactccagggcacttgtttttatcaggttacttactcaccggataatggaaattggcttattttcaattttacaattgactgatgaatgtattggtggtaattgatttatttcttcacttttttttgctactaaatgattttttcttttttaaaattattattattattattttgagatggagtctcactctgtcgcccaggctggagtgcagtggcgccatctcagctcactgcaagctctgcctcctgggttcatgcaattctcctgcctcagcctcccgagtagctgggattacaggtgcgtgccaccacgaccagctaatttttttgtatttttagtagagacagggtttcatcatgttaaccaggatggtctcgatctcctgacctcgtgatccacctgcctgggcctcccaaagtgagccactgtgcctggcccagtaagtgcttttttcttttggtttttccttctaacactgctcagaccaagacttacatttataaagagcaaatatattctgacctttcccctcaaagttgtattccatctagaatcaaggaaacaaatgcaaattcatcatttggggaaagcagacctcttgacagtaattcaagtccatggctatatgctaacccttgctactcaaagtgtggtccacagaccagcagcgttagcatcatctgtaagcttgttagaaatgcagaatctcaggccccacatcaaaccttcttcatcagaattggccttttaacaaatccccaggtgacctgtatgcaccagaaatattgataagcactggcctcacctcaccgtagtgataactaacctcgttaataattagagaatgaagctatctcttccttgagtctcatttacagaattatttgaagatgtgaaggtcctgaatgatcataaggattaaaaaaatgcatctttaaattccacttgaggttatataacttggatggtctacatcaaacataataaagtcaataagagatagtctttttccggtcttacctaaatagcactccatatccttgagccacctcaaagcccccatttttaagttttagtctttttttttttagaccagactagcaaagccatcagaatatcaggtggaacctcagggcaggtcctctggaaggctacaggagtctctgcttagcatagtacagaaattgttgtgtttctcgatccttgtgttcttcccttgaggaactcagcatctcaccagtaagaactcccctcccctagaggaaaatagcaagagaagttagtttaaccatctagaaacattgctaatctccttgaaagccaattctcttactcattgcaccaacaagaaacactccaaggtgggcaaggaaagacgtgaattctgatattggcgccataactcgatatgtacccagaaacagttatgttctaaattaatggctttaacctgttcattgtaaaaagtgccttggacttcaatctaaagaggtcagtataaatatgtatgtgtgtgtgtgacgtgtatgtaggcaaatatttacagatttatacatacataggtgcacacacatatacccgcacattcatatataatatatacatacatatataaatgcttcataatatatcatattgctattcacagctccatttcttttgtctggtcctatgtttatttgtttagtgagacctttacatagagaggttctattcggaacattgatgtattttttgtttgttttttactttttattaaaaaggtaaaggatattaaaaaaaaaaaaaaaagtcaagtgcctgaaggttttgaatggagttacggtaaactttctcaggtcaccaaagaggaaacatttttcctttggaaaacatttttctgtttcagtgactttgttttcccttggtggtaatgcataaataagagtggttaaagtgattttgtaagttttatttcaatccatttctgtggttcccataaggcaatagctaaaaatttgttcagtctagtgcccagttttctccacacatcagcatcagaagggcccggtcttcacatgctctgtgtggttttgttcgcgttgttactgtgttccttactaaggaaaggcaaatgaaattgcaggggctggagcttagaccagctccaaatatggcttccttttggtaacacacacagaaggtggactagtgggaagtctctctccctgaagcaggtgggaacctgtgtcttagaaggcagaggagtcccagtgaactctccacagctccatgggccctgcctgtctacagttatacaactgcctgtatgagtcagcctttctctaccttagccaaaggtcttctctttctgtggtgtgacagcttgtaatgaaccaacttgctctggttagaagtccctagagctccaggaagagtcgccaggtttccattgctgtgctcaaagctcaaggacacattatacttctttaaaccaactaaatctctctagctccctgcccccatggtgacactttcataataggcagggccaagtcagagaggtcatgccctgtatacagtgtcaatcagaagagacactgcaaaatgtcagaggtgaccagaaagacaacagatctctccagctgtcctcacagctgcaggcacatttgtggaattgtgagtaggaaggcttggcagccaggggatgggaaatgaatttccccaagttgaaaaccctgtacccttactttccttcccataaatttttctgtagttctaggtaaataataataataataaaaatgcaaattaggtgctttagaaggagtatgtaatatctgggactttttctaagttggtagacctaaaaaatgttttcaaaaatatatctagctgcatttctactgctgtcattccttaaagctcttcctccaaaaactccatatgaatgaatacatttaccaactcagtgattactaaataatagtactttatacttatacacagtaatacctttcatctaaggatctcaaatgccaatatattagtcatcaccctgtaaggtggatgacatattattcccattattccaatgggaaaattgggccatagaaaactgaggagcaaatgactcatctacaggaattaaatggaaaaaacaggctaggatttctcagcacactttaggagtgaatgaaaacttacaggcttcagttctactgctggccaccattggatttgtaagatccaggatgtgtattgaccacatgtgtccagacccaggcttagggcatctggaatgagagtggtgggctggtgtgtgggtctgaggatctggatgggagactgcattttcttctctgtgcaaaatatggaagtgtgaccttgaaggtgggcttagtctatggccttccccactcctgcttgaactgaagctggagagaatgggcatttttaaatgttacggcatatgctaatataatattatggcattaaataaaaacaagaagagaactgactaaaaccaaaaaaaaaaaaaaaaa

SEQ ID NO: 4290 - DNA, 4325 bp, homo sapiens
cacaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgccttggtgatctgcgtgggtcagtgcacacaggcacacgtcagcctcaaggacatgggcacatctgttcacaggagcagcgccacgtgcctttgagtgccaggaacggggtgggagggtgggagggtgtgagggccagaagactcagaagatgcaaagtgcctgagagagacgggatattcccccagaagaagcattcttagagacacaggcactggacctccttggttcttataagaaacctgtctgaagctgggtgatgagttgcacactccaggtggggctaaggggcctggagcccctgctggctcctaggaaggcacagcagcaggccctgagacggctcctctggggcccctccaccctcccaggcctctgcatttcacctgtgcccacacttctgtctcctgccttcaccttttgacccactactaacgattctccacccagcagacaaagtgatctcttaaaaatatctgttggctgggcacggtggctcacgcctgtaatcccagcactttaggaagccgaggcgggtggatcacctgaggtcgggagttcgagaccagcctgaccaacatggagaaaccccatctctactaaaaatacaaaattagccaggtgtagtggtgcatccctgtaatcccagctacttgggagtctgaggctggagaatcacttgaacctgggaggcggtggttgcagtgagccgagatcgcaccattgcactccagcctgggcaacaagagaaaaactctgtctcaaaaaacaaaaaatctgttaggctgcacacggcgattcactcctgtattcccagtgctttgggaggctgaggtgagaggatgcctgaggccaggaattcagaccagcctgggcaacatagtgagaccccagctctaaagatttgtttttgttttttttttttttttttttttttttttttttttttttttgagacggagtctcgctctgtcgcccaggctagagtgcagtggtaccatctccgctcactgcaacctccgcctcccgggttccagggattctcctgcctcagcctccctagtagctggaactacaggtgtgtgctgccatgcccagctaatttttttttatttaatagagacaagatttcaccatgttggccaggctggtctcaaactcctgacctcaggtgatccacccgcctcagcctcccaaagtgctgggattacaggtgtgaaccaccacacctggccaacaatatttgttttaattagccaggcgtggtagcatttgtcctagcaatttgggaggttgaggtgggagaatcacttcagcccactaggtcgaggctgtagtgagctataattgtaccactgcactccagcctcggggacagagtgagaccctgtctgcaaataaacaaataaaacatcaggctgggcttgagcatctattcctgctcaaaatttcgcaggcttctcagaagaaaatccaaaccccttacagtgacccagtttgcccttgaggcctccacccacacccccttccccccagtcttagggggtggcctggctgttcccttcaacggcaacgctctgcctccattgttggcctcctctgcagggagggactgtctgagcacctgcccgtgtctgtgcagcatggcacactgacgtcaggcccacgtgcatgcccaggtggccagtcacacgccaggtgctccctcagtgttggccaagtgagaggagcacaccttccgggcgttcagacacctccccgtggcagacaccgttcgttgctaccaaacagccacctccttcctaatgggctcccatttttcagtgctgggcaaaggtcccttgatcttggagttgcagcctctttctctccaaggagggcggtgaccagcctgagccagtcaatccagtgattggttcaggagtagcctgtgaccaggagtcctggtagtgaacgactggggcagccctgggggtgaggaccttgcgcagccgtcacaggccctgattggacactgggcagctgctaacccagtgtctccagctgcctacctggagagctccaagcgtaagaaaataaaccctgcctgttgaagccaaaaaaaaaaa

SEQ ID NO: 4291 - DNA, 3935 bp, homo sapiens
cacaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccgggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgccttggtgatctgcgtgggtcagtgcacacaggcacacgtcagcctcaaggacatgggcacatctgttcacaggagcagcgccacgtgcctttgagtgccaggaacggggtgggagggtgggagggtgtgagggccagaagactcagaagatgcaaagtgcctgagagagacgggatattcccccagaagaagcattcttagagacacaggcactggacctccttggttcttataagaaacctgtctgaagctgggtgatgagttgcacactccaggtggggctaaggggcctggagcccctgctggctcctaggaaggcacagcagcaggccctgagacggctcctctggggcccctccaccctcccaggcctctgcatttcacctgtgcccacacttctgtctcctgccttcaccttttgacccactactaacgattctccacccagcagacaaagtgatctcttaaaaatatctgttggctgggcacggtggctcacgcctgtaatcccagcactttaggaagccgaggcgggtggatcacctgaggtcgggagttcgagaccagcctgaccaacatggagaaaccccatctctactaaaaatacaaaattagccaggtgtagtggtgcatccctgtaatcccagctacttgggagtctgaggctggagaatcacttgaacctgggaggcggtggttgcagtgagccgagatcgcaccattgcactccagcctgggcaacaagagaaaaactctgtctcaaaaaacaaaaaatctgttaggctgcacacggcgattcactcctgtattcccagtgctttgggaggctgaggtgagaggatgcctgaggccaggaattcagaccagcctgggcaacatagtgagaccccagctctaaagatttgtttttgttttttttttttttttttttttttttttttttttttttttgagacggagtctcgctctgtcgcccaggctagagtgcagtggtaccatctccgctcactgcaacctccgcctcccgggttccagggattctcctgcctcagcctccctagtagctggaactacaggtgtgtgctgccatgcccagctaatttttttttatttaatagagacaagatttcaccatgttggccaggctggtctcaaactcctgacctcaggtgatccacccgcctcagcctcccaaagtgctgggattacaggtgtgaaccaccacacctggccaacaatatttgttttaattagccaggcgtggtagcatttgtcctagcaatttgggaggttgaggtgggagaatcacttcagcccactaggtcgaggctgtagtgagctataattgtaccactgcactccagcctcggggacagagtgagaccctgtctgcaaataaacaaataaaacatcaggctgggcttgagcatctattcctgctcaaaatttcgcaggcttctcagaagaaaatccaaaccccttacagtgacccagtttgcccttgaggcctccacccacacccccttccccccagtcttagggggtggcctggctgttcccttcaacggcaacgctctgcctccattgttggcctcctctgcagggagggactgtctgagcacctgcccgtgtctgtgcagcatggcacactgacgtcaggcccacgtgcatgcccaggtggccagtcacacgccaggtgctccctcagtgttggccaagtgagaggagcacaccttccgggcgttcagacacctccccgtggcagacaccgttcgttgctaccaaacagccacctccttcctaatgggctcccatttttcagtgctgggcaaaggtcccttgatcttggagttgcagcctctttctctccaaggagggcggtgaccagcctgagccagtcaatccagtgattggttcaggagtagcctgtgaccaggagtcctggtagtgaacgactggggcagccctgggggtgaggaccttgcgcagccgtcacaggccctgattggacactgggcagctgctaacccagtgtctccagctgcctacctggagagctccaagcgtaagaaaataaaccctgcctgttgaagccaaaaaaaaaaa

SEQ ID NO: 4292 - DNA, 4172 bp, homo sapiens
cacaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccgacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgccttggtgatctgcgtgggtcagtgcacacaggcacacgtcagcctcaaggacatgggcacatctgttcacaggagcagcgccacgtgcctttgagtgccaggaacggggtgggagggtgggagggtgtgagggccagaagactcagaagatgcaaagtgcctgagagagacgggatattcccccagaagaagcattcttagagacacaggcactggacctccttggttcttataagaaacctgtctgaagctgggtgatgagttgcacactccaggtggggctaaggggcctggagcccctgctggctcctaggaaggcacagcagcaggccctgagacggctcctctggggcccctccaccctcccaggcctctgcatttcacctgtgcccacacttctgtctcctgccttcaccttttgacccactactaacgattctccacccagcagacaaagtgatctcttaaaaatatctgttggctgggcacggtggctcacgcctgtaatcccagcactttaggaagccgaggcgggtggatcacctgaggtcgggagttcgagaccagcctgaccaacatggagaaaccccatctctactaaaaatacaaaattagccaggtgtagtggtgcatccctgtaatcccagctacttgggagtctgaggctggagaatcacttgaacctgggaggcggtggttgcagtgagccgagatcgcaccattgcactccagcctgggcaacaagagaaaaactctgtctcaaaaaacaaaaaatctgttaggctgcacacggcgattcactcctgtattcccagtgctttgggaggctgaggtgagaggatgcctgaggccaggaattcagaccagcctgggcaacatagtgagaccccagctctaaagatttgtttttgttttttttttttttttttttttttttttttttttttttttgagacggagtctcgctctgtcgcccaggctagagtgcagtggtaccatctccgctcactgcaacctccgcctcccgggttccagggattctcctgcctcagcctccctagtagctggaactacaggtgtgtgctgccatgcccagctaatttttttttatttaatagagacaagatttcaccatgttggccaggctggtctcaaactcctgacctcaggtgatccacccgcctcagcctcccaaagtgctgggattacaggtgtgaaccaccacacctggccaacaatatttgttttaattagccaggcgtggtagcatttgtcctagcaatttgggaggttgaggtgggagaatcacttcagcccactaggtcgaggctgtagtgagctataattgtaccactgcactccagcctcggggacagagtgagaccctgtctgcaaataaacaaataaaacatcaggctgggcttgagcatctattcctgctcaaaatttcgcaggcttctcagaagaaaatccaaaccccttacagtgacccagtttgcccttgaggcctccacccacacccccttccccccagtcttagggggtggcctggctgttcccttcaacggcaacgctctgcctccattgttggcctcctctgcagggagggactgtctgagcacctgcccgtgtctgtgcagcatggcacactgacgtcaggcccacgtgcatgcccaggtggccagtcacacgccaggtgctccctcagtgttggccaagtgagaggagcacaccttccgggcgttcagacacctccccgtggcagacaccgttcgttgctaccaaacagccacctccttcctaatgggctcccatttttcagtgctgggcaaaggtcccttgatcttggagttgcagcctctttctctccaaggagggcggtgaccagcctgagccagtcaatccagtgattggttcaggagtagcctgtgaccaggagtcctggtagtgaacgactggggcagccctgggggtgaggaccttgcgcagccgtcacaggccctgattggacactgggcagctgctaacccagtgtctccagctgcctacctggagagctccaagcgtaagaaaataaaccctgcctgttgaagccaaaaaaaaaaa

SEQ ID NO: 4293 - DNA, 4127 bp, homo sapiens
cacaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgccttggtgatctgcgtgggtcagtgcacacaggcacacgtcagcctcaaggacatgggcacatctgttcacaggagcagcgccacgtgcctttgagtgccaggaacggggtgggagggtgggagggtgtgagggccagaagactcagaagatgcaaagtgcctgagagagacgggatattcccccagaagaagcattcttagagacacaggcactggacctccttggttcttataagaaacctgtctgaagctgggtgatgagttgcacactccaggtggggctaaggggcctggagcccctgctggctcctaggaaggcacagcagcaggccctgagacggctcctctggggcccctccaccctcccaggcctctgcatttcacctgtgcccacacttctgtctcctgccttcaccttttgacccactactaacgattctccacccagcagacaaagtgatctcttaaaaatatctgttggctgggcacggtggctcacgcctgtaatcccagcactttaggaagccgaggcgggtggatcacctgaggtcgggagttcgagaccagcctgaccaacatggagaaaccccatctctactaaaaatacaaaattagccaggtgtagtggtgcatccctgtaatcccagctacttgggagtctgaggctggagaatcacttgaacctgggaggcggtggttgcagtgagccgagatcgcaccattgcactccagcctgggcaacaagagaaaaactctgtctcaaaaaacaaaaaatctgttaggctgcacacggcgattcactcctgtattcccagtgctttgggaggctgaggtgagaggatgcctgaggccaggaattcagaccagcctgggcaacatagtgagaccccagctctaaagatttgtttttgttttttttttttttttttttttttttttttttttttttttgagacggagtctcgctctgtcgcccaggctagagtgcagtggtaccatctccgctcactgcaacctccgcctcccgggttccagggattctcctgcctcagcctccctagtagctggaactacaggtgtgtgctgccatgcccagctaatttttttttatttaatagagacaagatttcaccatgttggccaggctggtctcaaactcctgacctcaggtgatccacccgcctcagcctcccaaagtgctgggattacaggtgtgaaccaccacacctggccaacaatatttgttttaattagccaggcgtggtagcatttgtcctagcaatttgggaggttgaggtgggagaatcacttcagcccactaggtcgaggctgtagtgagctataattgtaccactgcactccagcctcggggacagagtgagaccctgtctgcaaataaacaaataaaacatcaggctgggcttgagcatctattcctgctcaaaatttcgcaggcttctcagaagaaaatccaaaccccttacagtgacccagtttgcccttgaggcctccacccacacccccttccccccagtcttagggggtggcctggctgttcccttcaacggcaacgctctgcctccattgttggcctcctctgcagggagggactgtctgagcacctgcccgtgtctgtgcagcatggcacactgacgtcaggcccacgtgcatgcccaggtggccagtcacacgccaggtgctccctcagtgttggccaagtgagaggagcacaccttccgggcgttcagacacctccccgtggcagacaccgttcgttgctaccaaacagccacctccttcctaatgggctcccatttttcagtgctgggcaaaggtcccttgatcttggagttgcagcctctttctctccaaggagggcggtgaccagcctgagccagtcaatccagtgattggttcaggagtagcctgtgaccaggagtcctggtagtgaacgactggggcagccctgggggtgaggaccttgcgcagccgtcacaggccctgattggacactgggcagctgctaacccagtgtctccagctgcctacctggagagctccaagcgtaagaaaataaaccctgcctgttgaagccaaaaaaaaaaa

SEQ ID NO: 4294 - DNA, 4220 bp, homo sapiens
cacaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcaggacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgccttggtgatctgcgtgggtcagtgcacacaggcacacgtcagcctcaaggacatgggcacatctgttcacaggagcagcgccacgtgcctttgagtgccaggaacggggtgggagggtgggagggtgtgagggccagaagactcagaagatgcaaagtgcctgagagagacgggatattcccccagaagaagcattcttagagacacaggcactggacctccttggttcttataagaaacctgtctgaagctgggtgatgagttgcacactccaggtggggctaaggggcctggagcccctgctggctcctaggaaggcacagcagcaggccctgagacggctcctctggggcccctccaccctcccaggcctctgcatttcacctgtgcccacacttctgtctcctgccttcaccttttgacccactactaacgattctccacccagcagacaaagtgatctcttaaaaatatctgttggctgggcacggtggctcacgcctgtaatcccagcactttaggaagccgaggcgggtggatcacctgaggtcgggagttcgagaccagcctgaccaacatggagaaaccccatctctactaaaaatacaaaattagccaggtgtagtggtgcatccctgtaatcccagctacttgggagtctgaggctggagaatcacttgaacctgggaggcggtggttgcagtgagccgagatcgcaccattgcactccagcctgggcaacaagagaaaaactctgtctcaaaaaacaaaaaatctgttaggctgcacacggcgattcactcctgtattcccagtgctttgggaggctgaggtgagaggatgcctgaggccaggaattcagaccagcctgggcaacatagtgagaccccagctctaaagatttgtttttgttttttttttttttttttttttttttttttttttttttttgagacggagtctcgctctgtcgcccaggctagagtgcagtggtaccatctccgctcactgcaacctccgcctcccgggttccagggattctcctgcctcagcctccctagtagctggaactacaggtgtgtgctgccatgcccagctaatttttttttatttaatagagacaagatttcaccatgttggccaggctggtctcaaactcctgacctcaggtgatccacccgcctcagcctcccaaagtgctgggattacaggtgtgaaccaccacacctggccaacaatatttgttttaattagccaggcgtggtagcatttgtcctagcaatttgggaggttgaggtgggagaatcacttcagcccactaggtcgaggctgtagtgagctataattgtaccactgcactccagcctcggggacagagtgagaccctgtctgcaaataaacaaataaaacatcaggctgggcttgagcatctattcctgctcaaaatttcgcaggcttctcagaagaaaatccaaaccccttacagtgacccagtttgcccttgaggcctccacccacacccccttccccccagtcttagggggtggcctggctgttcccttcaacggcaacgctctgcctccattgttggcctcctctgcagggagggactgtctgagcacctgcccgtgtctgtgcagcatggcacactgacgtcaggcccacgtgcatgcccaggtggccagtcacacgccaggtgctccctcagtgttggccaagtgagaggagcacaccttccgggcgttcagacacctccccgtggcagacaccgttcgttgctaccaaacagccacctccttcctaatgggctcccatttttcagtgctgggcaaaggtcccttgatcttggagttgcagcctctttctctccaaggagggcggtgaccagcctgagccagtcaatccagtgattggttcaggagtagcctgtgaccaggagtcctggtagtgaacgactggggcagccctgggggtgaggaccttgcgcagccgtcacaggccctgattggacactgggcagctgctaacccagtgtctccagctgcctacctggagagctccaagcgtaagaaaataaaccctgcctgttgaagccaaaaaaaaaaa

SEQ ID NO: 4295 - DNA, 2104 bp, homo sapiens
cacgtgaccaaccgggtcacatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcaccatattttacttttgagagtctttaaagaggaaggggagtggagggaaccctgagctaggcttcaggaggcccgcgtcctacgcaggctctgccacaggggttagaccccaggtccgacgcttgaccttcctgggcctcaagtgccctcccctatcaaatgaagggatggacagcatgacctctgggtgtctctccaactcaccagttctaaaaagggtatcagattctattgtgacttcatagtgagaatttattatagattattttttagctattttttccatgtgtgaaccttgagtgatactaatcatgtaaagtaagagttctcttatgtattattttcggaagaggggtgtggtgactcctttatattcgtactgcactttgtttttccaaggaaatcagtgtcttttacgttgttatgatgaatcccacatggggccggtgatggtatgctgaagttcagccgttgaacacataggaatgtctgtggggtgactctactgtgctttatcttttaacattaagtgcctttggttcagaggggcagtcataagctctgtttccccctctccccaaagccttcagcgaacgtgaaatgtgcgctaaacggggaaacctgtttaattctagatatagggaaaaaggaacgaggaccttgaatgagctatattcagggtatccggtattttgtaatagggaataggaaaccttgttggctgtggaatatccgatgctttgaatcatgcactgtgttgaataaacgtatctgctaaatcaggcaaaaaaaaaaaaaaaaaa

SEQ ID NO: 4296 - DNA, 2119 bp, homo sapiens
cacgtgaccaaccgggtcacatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacaggcagttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccatcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcaccatattttacttttgagagtctttaaagaggaaggggagtggagggaaccctgagctaggcttcaggaggcccgcgtcctacgcaggctctgccacaggggttagaccccaggtccgacgcttgaccttcctgggcctcaagtgccctcccctatcaaatgaagggatggacagcatgacctctgggtgtctctccaactcaccagttctaaaaagggtatcagattctattgtgacttcatagtgagaatttattatagattattttttagctattttttccatgtgtgaaccttgagtgatactaatcatgtaaagtaagagttctcttatgtattattttcggaagaggggtgtggtgactcctttatattcgtactgcactttgtttttccaaggaaatcagtgtcttttacgttgttatgatgaatcccacatggggccggtgatggtatgctgaagttcagccgttgaacacataggaatgtctgtggggtgactctactgtgctttatcttttaacattaagtgcctttggttcagaggggcagtcataagctctgtttccccctctccccaaagccttcagcgaacgtgaaatgtgcgctaaacggggaaacctgtttaattctagatatagggaaaaaggaacgaggaccttgaatgagctatattcagggtatccggtattttgtaatagggaataggaaaccttgttggctgtggaatatccgatgctttgaatcatgcactgtgttgaataaacgtatctgctaaatcaggcaaaaaaaaaaaaaaaaaa

SEQ ID NO: 4297 - DNA, 2179 bp, homo sapiens
cacgtgaccaaccgggtcacatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacaggcagttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcaccatattttacttttgagagtctttaaagaggaaggggagtggagggaaccctgagctaggcttcaggaggcccgcgtcctacgcaggctctgccacaggggttagaccccaggtccgacgcttgaccttcctgggcctcaagtgccctcccctatcaaatgaagggatggacagcatgacctctgggtgtctctccaactcaccagttctaaaaagggtatcagattctattgtgacttcatagtgagaatttattatagattattttttagctattttttccatgtgtgaaccttgagtgatactaatcatgtaaagtaagagttctcttatgtattattttcggaagaggggtgtggtgactcctttatattcgtactgcactttgtttttccaaggaaatcagtgtcttttacgttgttatgatgaatcccacatggggccggtgatggtatgctgaagttcagccgttgaacacataggaatgtctgtggggtgactctactgtgctttatcttttaacattaagtgcctttggttcagaggggcagtcataagctctgtttccccctctccccaaagccttcagcgaacgtgaaatgtgcgctaaacggggaaacctgtttaattctagatatagggaaaaaggaacgaggaccttgaatgagctatattcagggtatccggtattttgtaatagggaataggaaaccttgttggctgtggaatatccgatgctttgaatcatgcactgtgttgaataaacgtatctgctaaatcaggcaaaaaaaaaaaaaaaaaa

SEQ ID NO: 4298 - DNA, 1468 bp, homo sapiens
gagattcagtgttgagatagcaaaattctgcccctcgttccttggcagggccctatgatttatgcaggagcagaggcagcacgcaatcgagctgtcaagagagcgtcagcttattaggcaaatgctgcgtggtttttgaagagggtcgacactataaaatcccactccaggctctggagtggagaaactcagagaccaagtccattgagagactgaggggaaagagaggagagaaagaaaaagagagtgggaacagtaaagagaaaggaagacaacctccagagaaagcccccggagacgtctctctgcagagaggcggcagcacccggctcacctgcgaagcgcctgggaagcgagtgcccctaacatgcggctgccgctgcttgtgtccgcgggagtcctgctggtggctctcctgccctgcccgccatgcagggcgctcctgagccgcgggccggtcccgggagctcggcaggcgccgcagcaccctcagcccttggatttcttccagccgccgccgcagtccgagcagccccagcagccgcaggctcggccggtcctgctccgcatgggagaggagtacttcctccgcctggggaacctcaacaagagcccggccgctcccctttcgcccgcctcctcgctcctcgccggaggcagcggcagccgcccttcgccggaacaggcgaccgccaactttttccgcgtgttgctgcagcagctgctgctgcctcggcgctcgctcgacagccccgcggctctcgcggagcgcggcgctaggaatgccctcggcggccaccaggaggcaccggagagagaaaggcggtccgaggagcctcccatctccctggatctcaccttccacctcctccgggaagtcttggaaatggccagggccgagcagttagcacagcaagctcacagcaacaggaaactcatggagattattgggaaataaaacggtgcgtttggccaaaaagaatctgcatttagcacaaaaaaaatttaaaaaaatacagtattctgtaccatagcgctgctcttatgccatttgtttatttttatatagcttgaaacatagagggagagagggagagagcctataccccttacttagcatgcacaaagtgtattcacgtgcagcagcaacacaatgttattcgttttgtctacgtttagtttccgtttccaggtgtttatagtggtgttttaaagagaatgtagacctgtgagaaaacgttttgtttgaaaaagcagacagaagtcactcaattgtttttgttgtggtctgagccaaagagaatgccattctcttgggtgggtaagactaaatctgtaagctctttgaaacaactttctcttgtaaacgtttcagtaataaaacatctttccagtccttggtcagtttggttgtgtaagagaatgttgaatacttatatttttaataaaagttgcaaaggtaatcatg

SEQ ID NO: 4299 - DNA, 2482 bp, homo sapiens
agctgtcagagatcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccagaaaaaaaaaaa

SEQ ID NO: 4300 - DNA, 2479 bp, homo sapiens
agctgtcagagatcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccagaaaaaaaaaaa

SEQ ID NO: 4301 - protein, 635 aa, homo sapiens
MSGAGRALAALLLAASVLSAALLAPGGSSGRDAQAAPPRDLDKKRHAELKMDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLSLDDFNNWISKAISSRETDRLINSELGSPSRTDPLDGDVQPATWRLSALPPRLRSVDTFRGIALILMVFVNYGGGKYWYFKHASWNGLTVADLVFPWFVFIMGSSIFLSMTSILQRGCSKFRLLGKIAWRSFLLICIGIIIVNPNYCLGPLSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILGLISVALTKVSENEGFIPVNKNLWSLSYVTTLSSFAFFILLVLYPVVDVKGLWTGTPFFYPGMNSILVYVGHEVFENYFPFQWKLKDNQSHKEHLTQNIVATALWVLIAYILYRKKIFWKI

SEQ ID NO: 4302 - protein, 463 aa, homo sapiens
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 4303 - protein, 473 aa, homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 4304 - protein, 197 aa, homo sapiens
MQRWKAAALASVLCSSVLSIWMCREGLLLSHRLGPALVPLHRLPRTLDARIARLAQYRALLQGAPDAMELRELTPWAGRPPGPRRRAGPRRRRARARLGARPCGLRELEVRVSELGLGYASDETVLFRYCAGACEAAARVYDLGLRRLRQRRRLRRERVRAQPCCRPTAYEDEVSFLDAHSRYHTVHELSARECACV

SEQ ID NO: 4305 - protein, 170 aa, homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 4306 - protein, 533 aa, homo sapiens
MSIQVEHPAGGYKKLFETVEELSSPLTAHVTGRIPLWLTGSLLRCGPGLFEVGSEPFYHLFDGQALLHKFDFKEGHVTYHRRFIRTDAYVRAMTEKRIVITEFGTCAFPDPCKNIFSRFFSYFRGVEVTDNALVNVYPVGEDYYACTETNFITKINPETLETIKQVDLCNYVSVNGATAHPHIENDGTVYNIGNCFGKNFSIAYNIVKIPPLQADKEDPISKSEIVVQFPCSDRFKPSYVHSFGLTPNYIVFVETPVKINLFKFLSSWSLWGANYMDCFESNETMGVWLHIADKKRKKYLNNKYRTSPFNLFHHINTYEDNGFLIVDLCCWKGFEFVYNYLYLANLRENWEEVKKNARKAPQPEVRRYVLPLNIDKADTGKNLVTLPNTTATAILCSDETIWLEPEVLFSGPRQAFEFPQINYQKYCGKPYTYAYGLGLNHFVPDRLCKLNVKTKETWVWQEPDSYPSEPIFVSHPDALEEDDGVVLSVVVSPGAGQKPAYLLILNAKDLSEVARAEVEINIPVTFHGLFKKS

SEQ ID NO: 4307 - protein, 211 aa, homo sapiens
MKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 4308 - protein, 185 aa, homo sapiens
MKLWDVVAVCLVLLHTASAFPLPAANMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 4309 - protein, 809 aa, homo sapiens
MFKSLTKVNKVKPIGENNENEQSSRRNEEGSHPSNQSQQTTAQEENKGEEKSLKTKSTPVTSEEPHTNIQDKLSKKNSSGDLTTNPDPQNAAEPTGTVPEQKEMDPGKEGPNSPQNKPPAAPVINEYADAQLHNLVKRMRQRTALYKKKLVEGDLSSPEASPQTAKPTAVPPVKESDDKPTEHYYRLLWFKVKKMPLTEYLKRIKLPNSIDSYTDRLYLLWLLLVTLAYNWNCCFIPLRLVFPYQTADNIHYWLIADIICDIIYLYDMLFIQPRLQFVRGGDIIVDSNELRKHYRTSTKFQLDVASIIPFDICYLFFGFNPMFRANRMLKYTSFFEFNHHLESIMDKAYIYRVIRTTGYLLFILHINACVYYWASNYEGIGTTRWVYDGEGNEYLRCYYWAVRTLITIGGLPEPQTLFEIVFQLLNFFSGVFVFSSLIGQMRDVIGAATANQNYFRACMDDTIAYMNNYSIPKLVQKRVRTWYEYTWDSQRMLDESDLLKTLPTTVQLALAIDVNFSIISKVDLFKGCDTQMIYDMLLRLKSVLYLPGDFVCKKGEIGKEMYIIKHGEVQVLGGPDGTKVLVTLKAGSVFGEISLLAAGGGNRRTANVVAHGFANLLTLDKKTLQEILVHYPDSERILMKKARVLLKQKAKTAEATPPRKDLALLFPPKEETPKLFKTLLGGTGKASLARLLKLKREQAAQKKENSEGGEEEGKENEDKQKENEDKQKENEDKGKENEDKDKGREPEEKPLDRPECTASPIAVEEEPHSVRRTVLPRGTSRQSLIISMAPSAEGGEEVLTIEVKEKAKQ

SEQ ID NO: 4310 - protein, 247 aa, homo sapiens
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 4311 - protein, 247 aa, homo sapiens; identical to SEQ ID NO: 4310

SEQ ID NO: 4312 - protein, 247 aa, homo sapiens; identical to SEQ ID NO: 4310

SEQ ID NO: 4313 - protein, 247 aa, homo sapiens; identical to SEQ ID NO: 4310

SEQ ID NO: 4314 - protein, 247 aa, homo sapiens; identical to SEQ ID NO: 4310

SEQ ID NO: 4315 - protein, 262 aa, homo sapiens
MQSREEEWFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 4316 - protein, 247 aa, homo sapiens; identical to SEQ ID NO: 4310

SEQ ID NO: 4317 - protein, 255 aa, homo sapiens
MFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 4318 - protein, 247 aa, homo sapiens; identical to SEQ ID NO: 4310

SEQ ID NO: 4319 - protein, 247 aa, homo sapiens; identical to SEQ ID NO: 4310

SEQ ID NO: 4320 - protein, 276 aa, homo sapiens
MLCAISLCARVRKLRSAGRCGKFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 4321 - protein, 329 aa, homo sapiens
MCGATSFLHECTRLILVTTQNAEFLQKGLQVHTCFGVYPHASVWHDCASQKKGCAVYLHVSVEFNKLIPENGFIKFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 4322 - protein, 247 aa, homo sapiens; identical to SEQ ID NO: 4310

SEQ ID NO: 4323 - protein, 247 aa, homo sapiens; identical to SEQ ID NO: 4310

SEQ ID NO: 4324 - protein, 247 aa, homo sapiens; identical to SEQ ID NO: 4310

SEQ ID NO: 4325 - protein, 247 aa, homo sapiens; identical to SEQ ID NO: 4310

SEQ ID NO: 4326 - protein, 247 aa, homo sapiens; identical to SEQ ID NO: 4310

SEQ ID NO: 4327 - protein, 639 aa, homo sapiens
MLPGLALLLLAAWTARALEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4328 - protein, 695 aa, homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4329 - protein, 751 aa, homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4330 - protein, 714 aa, homo sapiens
MLPGLALLLLAAWTARALEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4331 - protein, 746 aa, homo sapiens
MDQLEDLLVLFINYVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4332 - protein, 770 aa, homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4333 - protein, 660 aa, homo sapiens
MFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 4334 - protein, 313 aa, homo sapiens
MTSCHIAEEHIQKVAIFGGTHGNELTGVFLVKHWLENGAEIQRTGLEVKPFITNPRAVKKCTRYIDCDLNRIFDLENLGKKMSEDLPYEVRRAQEINHLFGPKDSEDSYDIIFDLHNTTSNMGCTLILEDSRNNFLIQMFHYIKTSLAPLPCYVYLIEHPSLKYATTRSIAKYPVGIEVGPQPQGVLRADILDQMRKMIKHALDFIHHFNEGKEFPPCAIEVYKIIEKVDYPRDENGEIAAIIHPNLQDQDWKPLHPGDPMFLTLDGKTIPLGGDCTVYPVFVNEAAYYEKKEAFAKTTKLTLNAKSIRCCLH

SEQ ID NO: 4335 - protein, 313 aa, homo sapiens; identical to SEQ ID NO: 4334

SEQ ID NO: 4336 - protein, 382 aa, homo sapiens
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 4337 - protein, 460 aa, homo sapiens
MPLRRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 4338 - protein, 343 aa, homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGFLMRTNT

SEQ ID NO: 4339 - protein, 550 aa, homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 4340 - protein, 361 aa, homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKFGNSGGPLVNLDGEVIGVNTMKVTAGISFAIPSDRLREFLHRGEKKNSSSGISGSQRRYIGVMMLTLSPRAGLRPGDVILAIGEQMVQNAEDVYEAVRTQSQLAVQIRRGRETLTLYVTPEVTE

SEQ ID NO: 4341 - protein, 458 aa, homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLDGEVIGVNTMKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQNAEDVYEAVRTQSQLAVQIRRGRETLTLYVTPEVTE

SEQ ID NO: 4342 - protein, 187 aa, homo sapiens
MWCASPVAVVAFCAGLLVSHPVLTQGQEAGGRPGADCEVCKEFLNRFYKSLIDRGVNFSLDTIEKELISFCLDTKGKENRLCYYLGATKDAATKILSEVTRPMSVHMPAMKICEKLKKLDSQICELKYEKTLDLASVDLRKMRVAELKQILHSWGEECRACAEKTDYVNLIQELAPKYAATHPKTEL

SEQ ID NO: 4343 - protein, 198 aa, homo sapiens
MADQRQRSLSTSGESLYHVLGLDKNATSDDIKKSYRKLALKYHPDKNPDNPEAADKFKEINNAHAILTDATKRNIYDKYGSLGLYVAEQFGEENVNTYFVLSSWWAKALFVFCGLLTCCYCCCCLCCCFNCCCGKCKPKAPEGEETEFYVSPEDLEAQLQSDEREATDTPIVIQPASATETTQLTADSHPSYHTDGFN

SEQ ID NO: 4344 - protein, 653 aa, homo sapiens
MRPLRPRAALLALLASLLAAPPVAPAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 4345 - protein, 807 aa, homo sapiens
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 4346 - protein, 302 aa, homo sapiens
MEIQELEEIQACQGLWEVFVTLSERARDYLHKTGRFIVIGGIVSPVHDSYGKQGLVSSRHRLIMCQLAVQNSDWIRVDPWECYQDTWQTTCSVLEHHRDLMKRVTGCILSNVNTPSMTPVIGQPQNETPQPIYQNSNVATKPTAAKILGKVGESLSRICCVRPPVERFTFVDENANLGTVMRYEEIELRILLLCGSDLLESFCIPGLWNEADMEVIVGDFGIVVVPRDAADTDRIMNHSSILRKYKNNIMVVKDDINHPMSVVSSTKSRLALQHGDGHVVDYLSQPVIDYILKSQLYINASG

SEQ ID NO: 4347 - protein, 307 aa, homo sapiens
MTETTKTHVILLACGSFNPITKGHIQMFERARDYLHKTGRFIVIGGIVSPVHDSYGKQGLVSSRHRLIMCQLAVQNSDWIRVDPWECYQDTWQTTCSVLEHHRDLMKRVTGCILSNVNTPSMTPVIGQPQNETPQPIYQNSNVATKPTAAKILGKVGESLSRICCVRPPVERFTFVDENANLGTVMRYEEIELRILLLCGSDLLESFCIPGLWNEADMEVIVGDFGIVVVPRDAADTDRIMNHSSILRKYKNNIMVVKDDINHPMSVVSSTKSRLALQHGDGHVVDYLSQPVIDYILKSQLYINASG

SEQ ID NO: 4348 - protein, 632 aa, homo sapiens [sequence omitted]

SEQ ID NO: 4349 - protein, 486 aa, homo sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPLLPPLPPPPPEPESSEDPTSPPEPQDLSSSVCKEEKMPRGGSLESDGCPKEPAKTQPAVATAATAAEKYKHRGEGERKDIVSSSMPRPNREEPVDSRTPVTERVS

SEQ ID NO: 4350 - protein, 498 aa, homo sapiens [sequence omitted]

SEQ ID NO: 4351 - protein, 552 aa, homo sapiens
MRLLPLAPGRLRRGSPRHLPSCSPALLLLVLGGCLGVFGVAAGTRRPNVVLLLTDDQDEVLGGMTPLKKTKALIGEMGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 4352 - protein, 207 aa, homo sapiens
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDRAATPHHRPQPRSVPGWDSAPGAPSPADITHPTPAPGPSAHAAPSTTSALTPGPAAAAADAAASSVAKGGA

SEQ ID NO: 4353 - protein, 735 aa, homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGII

SEQ ID NO: 4354 - protein, 826 aa, homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 4355 - protein, 418 aa, homo sapiens
MQALVLLLCIGALLGHSSCQNPASPPEEGSPDPDSTGALVEEEDPFFKVPVNKLAAAVSNFGYDLYRVRSSTSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPSPGLQPAHLTFPLDYHLNQPFIFVLRDTDTGALLFIGKILDPRGP

SEQ ID NO: 4356 - protein, 317 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 4357 - protein, 232 aa, homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 4358 - protein, 354 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 4359 - protein, 327 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 4360 - protein, 395 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 4361 - protein, 137 aa, homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 4362 - protein, 412 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 4363 - protein, 191 aa, homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 4364 - protein, 371 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 4365 - protein, 389 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 4366 - protein, 371 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 4367 - protein, 174 aa, homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 4368 - protein, 191 aa, homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 4369 - protein, 209 aa, homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 4370 - protein, 215 aa, homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 4371 - protein, 147 aa, homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 4372 - protein, 247 aa, homo sapiens
MLQNSAVLLVLVISASATHEAEQNDSVSPRKSRVAAQNSAEVVRCLNSALQVGCGAFACLENSTCDTDGMYDICKSFLYSAAKFDTQGKAFVKESLKCIANGVTSKVFLAIRRCSTFQRMIAEVQEECYSKLNVCSIAKRNPEAITEVVQLPNHFSNRYYNRLVRSLLECDEDTVSTIRDSLMEKIGPNMASLFHILQTDHCAQTHPRADFNRRRTNEPQKLKVLLRNLRGEEDSPSHIKRTSHESA

SEQ ID NO: 4373 - protein, 151 aa, homo sapiens
MERPEPELIRQSWRAVSRSPLEHGTVLFARLFALEPDLLPLFQYNCRQFSSPEDCLSSPEFLDHIRKVMLVIDAAVTNVEDLSSLEEYLASLGRKHRAVGVKLSSFSTVGESLLYMLEKCLGPAFTPATRAAWSQLYGAVVQAMSRGWDGE

SEQ ID NO: 4374 - protein, 589 aa, homo sapiens
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 4375 - protein, 605 aa, homo sapiens
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 4376 - protein, 582 aa, homo sapiens
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNESLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 4377 - protein, 816 aa, homo sapiens
MAEPLKEEDGEDGSAEPPGPVKAEPAHTAASVAAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 4378 - protein, 816 aa, homo sapiens; identical to SEQ ID NO: 4377

SEQ ID NO: 4379 - protein, 677 aa, homo sapiens
MESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 4380 - protein, 816 aa, homo sapiens; identical to SEQ ID NO: 4377

SEQ ID NO: 4381 - protein, 279 aa, homo sapiens
MENSEKTEVVLLACGSFNPITNMHLRLFELAKDYMNGTGRYTVVKGIISPVGDAYKKKGLIPAYHRVIMAELATKNSKWVEVDTWESLQKEWKETLKVLRHHQEKLEASDCDHQQNSPTLERPGRKRKWTETQDSSQKKSLEPKTKAVPKVKLLCGADLLESFAVPNLWKSEDITQIVANYGLICVTRAGNDAQKFIYESDVLWKHRSNIHVVNEWIANDISSTKIRRALRRGQSIRYLVPDLVQEYIEKHNLYSSESEDRNAGVILAPLQRNTAEAKT

SEQ ID NO: 4382 - protein, 241 aa, homo sapiens
MSMLFYTLITAFLIGIQAEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVCDSVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 4383 - protein, 743 aa, homo sapiens
MEAVAVAAAVGVLLLAGAGGAAGDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 4384 - protein, 449 aa, homo sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 4385 - protein, 750 aa, homo sapiens
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLLPDIYGWPVATENWEQKYGASWTAEKAIAQLNSKYGKKVLINLFVGTDDKNSVNHVIHIDQPRLGLPSRDYYECTGIYKEACTAYVDFMISVARLIRQEERLPIDENQLALEMNKVMELEKEIANATAKPEDRNDPMLLYNKMTLAQIQNNFSLEINGKPFSWLNFTNEIMSTVNISITNEEDVVVYAPEYLTKLKPILTKYSARDLQNLMSWRFIMDLVSSLSRTYKESRNAFRKALYGTTSETATWRRCANYVNGNMENAVGRLYVEAAFAGESKHVVEDLIAQIREVFIQTLDDLTWMDAETKKRAEEKALAIKERIGYPDDIVSNDNKLNNEYLELNYKEDEYFENIIQNLKFSQSKQLKKLREKVDKDEWISGAAVVNAFYSSGRNQIVFPAGILQPPFFSAQQSNSLNYGGIGMVIGHEITHGFDDNGRNFNKDGDLVDWWTQQSASNFKEQSQCMVYQYGNFSWDLAGGQHLNGINTLGENIADNGGLGQAYRAYQNYIKKNGEEKLLPGLDLNHKQLFFLNFAQVWCGTYRPEYAVNSIKTDVHSPGNFRIIGTLQNSAEFSEAFHCRKNSYMNPEKKCRVW

SEQ ID NO: 4386 - protein, 750 aa, homo sapiens; identical to SEQ ID NO: 4385

SEQ ID NO: 4387 - protein, 750 aa, homo sapiens; identical to SEQ ID NO: 4385

SEQ ID NO: 4388 - protein, 750 aa, homo sapiens; identical to SEQ ID NO: 4385

SEQ ID NO: 4389 - protein, 480 aa, homo sapiens
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 4390 - protein, 498 aa, homo sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 4391 - protein, 481 aa, homo sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 4392 - protein, 306 aa, homo sapiens
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 4393 - protein, 203 aa, homo sapiens
MASPGCLWLLAVALLPWTCASRALQHLDPPAPLPLVIWHGMGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 4394 - protein, 220 aa, homo sapiens
MGAAARTLRLALGLLLLATLLRPADACSCSPVHPQQAFCNADVVIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 4395 - protein, 185 aa, homo sapiens
MRRMRRMWATQGLAVALALSVLPGSRALRPGDCEVCISYLGRFYQDLKDRDVTFSPATIENELIKFCREARGKENRLCYYIGATDDAATKIINEVSKPLAHHIPVEKICEKLKKKDSQICELKYDKQIDLSTVDLKKLRVKELKKILDDWGETCKGCAEKSDYIRKINELMPKYAPKAASARTDL

SEQ ID NO: 4396 - protein, 207 aa, homo sapiens
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 4397 - protein, 585 aa, homo sapiens
MASPGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGGAISNMYAMMIARFKMFPEVKEKGMAALPRLIAFTSEHSHFSLKKGAAALGIGTDSVILIKCDERGKMIPSDLERRILEAKQKGFVPFLVSATAGTTVYGAFDPLLAVADICKKYKIWMHVDAAWGGGLLMSRKHKWKLSGVERANSVTWNPHKMMGVPLQCSALLVREEGLMQNCNQMHASYLFQQDKHYDLSYDTGDKALQCGRHVDVFKLWLMWRAKGTTGFEAHVDKCLELAEYLYNIIKNREGYEMVFDGKPQHTNVCFWYIPPSLRTLEDNEERMSRLSKVAPVIKARMMEYGTTMVSYQPLGDKVNFFRMVISNPAATHQDIDFLIEEIERLGQDL

SEQ ID NO: 4398 - protein, 585 aa, homo sapiens; identical to SEQ ID NO: 4397

SEQ ID NO: 4399 - protein, 685 aa, homo sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 4400 - protein, 594 aa, homo sapiens
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVVDILLNYVRKTFDRSTKVLDFHHPHQLLEGMEGFNLELSDHPESLEQILVDCRDTLKYGVRTGHPRFFNQLSTGLDIIGLAGEWLTSTANTNMFTYEIAPVFVLMEQITLKKMREIVGWSSKDGDGIFSPGGAISNMYSIMAARYKYFPEVKTKGMAAVPKLVLFTSEQSHYSIKKAGAALGFGTDNVILIKCNERGKIIPADFEAKILEAKQKGYVPFYVNATAGTTVYGAFDPIQEIADICEKYNLWLHVDAAWGGGLLMSRKHRHKLNGIERANSVTWNPHKMMGVLLQCSAILVKEKGILQGCNQMCAGYLFQPDKQYDVSYDTGDKAIQCGRHVDIFKFWLMWKAKGTVGFENQINKCLELAEYLYAKIKNREEFEMVFNGEPEHTNVCFWYIPQSLRGVPDSPQRREKLHKVAPKIKALMMESGTTMVGYQPQGDKANFFRMVISNPAATQSDIDFLIEEIERLGQDL

SEQ ID NO: 4401 - protein, 224 aa, homo sapiens
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVVDILLNYVRKTFDRSTKVLDFHHPHQLLEGMEGFNLELSDHPESLEQILVDCRDTLKYGVRTGHPRFFNQLSTGLDIIGLAGEWLTSTANTNMPSDMRECWLLR

SEQ ID NO: 4402 - protein, 257 aa, homo sapiens
MSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 4403 - protein, 270 aa, homo sapiens
MVTFATILQVNKVMSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 4404 - protein, 651 aa, homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 4405 - protein, 723 aa, homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 4406 - protein, 290 aa, homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 4407 - protein, 210 aa, homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEGK

SEQ ID NO: 4408 - protein, 728 aa, homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 4409 - protein, 285 aa, homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 4410 - protein, 410 aa, homo sapiens
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIPYEGDEISMMLVLSRQEVPLATLEPLVKAQLVEEWANSVKKQKVEVYLPRFTVEQEIDLKDVLKALGITEIFIKDANLTGLSDNKEIFLSKAIHKSFLEVNEEGSEAAAVSGMIAISRMAVLYPQVIVDHPFFFLIRNRRTGTILFMGRVMHPETMNTSGHDFEEL

SEQ ID NO: 4411 - protein, 410 aa, homo sapiens; identical to SEQ ID NO: 4410

SEQ ID NO: 4412 - protein, 211 aa, homo sapiens
MQSAMFLAVQHDCRPMDKSAGSGHKSEEKREKMKRTLLKDWKTRLSYFLQNSSTPGKPKTGKKSKQQAFIKPSPEEAQLWSEAFDELLASKYGLAAFRAFLKSEFCEENIEFWLACEDFKKTKSPQKLSSKARKIYTDFIEKEAPKEINIDFQTKTLIAQNIQEATSGCFTTAQKRVYSLMENNSYPRFLESEFYQDLCKKPQITTEPHAT

SEQ ID NO: 4413 - protein, 97 aa, homo sapiens
MLGNKRLGLSGLTLALSLLVCLGALAEAYPSKPDNPGEDAPAEDMARYYSALRHYINLITRQRYGKRSSPETLISDLLMRESTENVPRTRLEDPAMW

SEQ ID NO: 4414 - protein, 309 aa, homo sapiens
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 4415 - protein, 116 aa, homo sapiens
MLSCRLQCALAALSIVLALGCVTGAPSDPRLRQFLQKSLAAAAGKQELAKYFLAELLSEPNQTENDALEPEDLSQAAEQDEMRLELQRSANSNPAMAPRERKAGCKNFFWKTFTSC

SEQ ID NO: 4416 - protein, 502 aa, homo sapiens
MSCPVPACCALLLVLGLCRARPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 4417 - protein, 502 aa, homo sapiens
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 4418 - protein, 193 aa, homo sapiens
MQSLMQAPLLIALGLLLAAPAQAHLKKPSQLSSFSWDNCDEGKDPAVIRSLTLEPDPIIVPGNVTLSVMGSTSVPLSSPLKVDLVLEKEVAGLWIKIPCTDYIGSCTFEHFCDVLDMLIPTGEPCPEPLRTYGLPCHCPFKEGTYSLPKSEFVVPDLELPSWLTTGNYRIESVLSSSGKRLGCIKIAASLKGI

SEQ ID NO: 4419 - protein, 186 aa, homo sapiens
MQSLMQAPLLIALGLLLAAPAQAHLKKPSQLSSFSWDNCDEGKDPAVIRSLTLEPDPIIVPGNVTLSVMGSTSVPLSSPLKVDLVLEKEVAGLWIKIPCTDYIGSCTFEHFCDVLDMLIPTGEPCPEPLRTYGLPCHCPFSSVLCLPRPNSHSLPPFNPLSTVSPLPSLKIILYHLHFRLGQAALT

SEQ ID NO: 4420 - protein, 529 aa, homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYIVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 4421 - protein, 223 aa, homo sapiens [sequence omitted]

SEQ ID NO: 4422 - protein, 556 aa, homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 4423 - protein, 581 aa, homo sapiens
MAVRQALGRGLQLGRALLLRFTGKPGRAYGLGRPGPAAGCVRGERPGWAAGPGAEPRRVGLGLPNRLRFFRQSVAGLAARLQRQFVVRAWGCAGPCGRAVFLAFGLGLGLIEEKQAESRRAVSACQEIQAIFTQKSKPGPDPLDTRRLQGFRLEEYLIGQSIGKGCSAAVYEATMPTLPQNLEVTKSTGLLPGRGPGTSAPGEGQERAPGAPAFPLAIKMMWNISAGSSSEAILNTMSQELVPASRVALAGEYGAVTYRKSKRGPKQLAPHPNIIRVLRAFTSSVPLLPGALVDYPDVLPSRLHPEGLGHGRTLFLVMKNYPCTLRQYLCVNTPSPRLAAMMLLQLLEGVDHLVQQGIAHRDLKSDNILVELDPDGCPWLVIADFGCCLADESIGLQLPFSSWYVDRGGNGCLMAPEVSTARPGPRAVIDYSKADAWAVGAIAYEIFGLVNPFYGQGKAHLESRSYQEAQLPALPESVPPDVRQLVRALLQREASKRPSARVAANVLHLSLWGEHILALKNLKLDKMVGWLLQQSAATLLANRLTEKCCVETKMKMLFLANLECETLCQAALLLCSWRAAL

SEQ ID NO: 4424 - protein, 256 aa, homo sapiens
MAAAVGRLLRASVARHVSAIPWGISATAALRPAACGRTSLTNLLCSGSSQAKLFSTSSSCHAPAVTQHAPYFKGTAVVNGEFKDLSLDDFKGKYLVLFFYPLDFTFVCPTEIVAFSDKANEFHDVNCEVVAVSVDSHFSHLAWINTPRKNGGLGHMNIALLSDLTKQISRDYGVLLEGSGLALRGLFIIDPNGVIKHLSVNDLPVGRSVEETLRLVKAFQYVETHGEVCPANWTPDSPTIKPSPAASKEYFQKVNQ

SEQ ID NO: 4425 - protein, 199 aa, homo sapiens
MSSGNAKIGHPAPNFKATAVMPDGQFKDISLSDYKGKYVVFFFYPLDFTFVCPTEIIAFSDRAEEFKKLNCQVIGASVDSHFCHLAWVNTPKKQGGLGPMNIPLVSDPKRTIAQDYGVLKADEGISFRGLFIIDDKGILRQITVNDLPVGRSVDETLRLVQAFQFTDKHGEVCPAGWKPGSDTIKPDVQKSKEYFSKQK

SEQ ID NO: 4426 - protein, 199 aa, homo sapiens; identical to SEQ ID NO: 4425

SEQ ID NO: 4427 - protein, 199 aa, homo sapiens; identical to SEQ ID NO: 4425

SEQ ID NO: 4428 - protein, 546 aa, homo sapiens
MPGFLVRILPLLLVLLLLGPTRGLRNATQRMFEIDYSRDSFLKDGQPFRYISGSIHYSRVPRFYWKDRLLKMKMAGLNAIQTLPGSCGQVVGSPSAQDEASPLSEWRASYNSAGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 4429 - protein, 647 aa, homo sapiens
MFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 4430 - protein, 677 aa, homo sapiens
MPGFLVRILPLLLVLLLLGPTRGLRNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 4431 - protein, 563 aa, homo sapiens
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 4432 - protein, 147 aa, homo sapiens
MVMGLGVLLLVFVLGLGLTPPTLAQDNSRYTHFLTQHYDAKPQGRDDRYCESIMRRRGLTSPCKDINTFIHGNKRSIKAICENKNGNPHRENLRISKSSFQVTTCKLHGGSPWPPCQYRATAGFRNVVVACENGLPVHLDQSIFRRP

SEQ ID NO: 4433 - protein, 147 aa, homo sapiens; identical to SEQ ID NO: 4432

SEQ ID NO: 4434 - protein, 288 aa, homo sapiens
MERPQPDSMPQDLSEALKEATKEVHTQAENAEFMRNFQKGQVTRDGFKLVMASLYHIYVALEEEIERNKESPVFAPVYFPEELHRKAALEQDLAFWYGPRWQEVIPYTPAMQRYVKRLHEVGRTEPELLVAHAYTRYLGDLSGGQVLKKIAQKALDLPSSGEGLAFFTFPNIASATKFKQLYRSRMNSLEMTPAVRQRVIEEAKTAFLLNIQLFEELQELLTHDTKDQSPSRAPGLRQRASNKVQDSAPVETPRGKPPLNTRSQAPLLRWVLTLSFLVATVAVGLYAM

SEQ ID NO: 4435 - protein, 640 aa, homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 4436 - protein, 177 aa, homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCK

SEQ ID NO: 4437 - protein, 459 aa, homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 4438 - protein, 207 aa, homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 4439 - protein, 462 aa, homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 4440 - protein, 422 aa, homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 4441 - protein, 607 aa, homo sapiens
MGKGRAGRVGTTALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSATSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 4442 - protein, 308 aa, homo sapiens
MQIPKHISIEDITATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 4443 - protein, 645 aa, homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 4444 - protein, 624 aa, homo sapiens
MGKGRAGRVGTTALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 4445 - protein, 420 aa, homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSER

SEQ ID NO: 4446 - protein, 637 aa, homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 4447 - protein, 241 aa, homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 4448 - protein, 296 aa, homo sapiens
MEIYSPDMSEVAAERSSSPSTQLSADPSLDGLPAAEDMPEPQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLSTSTSTTGTSHLVKCAEKEKTFCVNGGECFMVKDLSNPSRYLCKCPNEFTGDRCQNYVMASFYSTSTPFLSLPE

SEQ ID NO: 4449 - protein, 194 aa, homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSATSTSTTGTSHLVKCAEKEKTFCVNGGECFMVKDLSNPSRYLCK

SEQ ID NO: 4450 - protein, 211 aa, homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCK

SEQ ID NO: 4451 - protein, 590 aa, homo sapiens
MGKGRAGRVGTTALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 4452 - protein, 462 aa, homo sapiens
MQLRKMQTVKKEQASLDASSNVDKMMVLNSALTEVSEDSTTGEELLLSEGSVGKNKSSACRRKREFIPDEKKDAMYWEKRRKNNEAAKRSREKRRLNDLVLENKLIALGEENATLKAELLSLKLKFGLISSTAYAQEIQKLSNSTAVYFQDYQTSKSNVSSFVDEHEPSMVSSSCISVIKHSPQSSLSDVSEVSSVEHTQESSVQGSCRSPENKFQIIKQEPMELESYTREPRDDRGSYTASIYQNYMGNSFSGYSHSPPLLQVNRSSSNSPRTSETDDGVVGKSSDGEDEQQVPKGPIHSPVELKHVHATVVKVPEVNSSALPHKLRIKAKAMQIKVEAFDNEFEATQKLSSPIDMTSKRHFELEKHSAPSMVHSSLTPFSVQVTNIQDWSLKSEHWHQKELSGKTQNSFKTGVVEMKDSGYKVSDPENLYLKQGIANLSAEVVSLKRLIATQPISASDSG

SEQ ID NO: 4453 - protein, 1011 aa, homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 4454 - protein, 516 aa, homo sapiens
MEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 4455 - protein, 480 aa, homo sapiens
MNASEFRRRGKEMVDYVANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 4456 - protein, 480 aa, homo sapiens; identical to SEQ ID NO: 4455

SEQ ID NO: 4457 - protein, 209 aa, homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 4458 - protein, 214 aa, homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 4459 - protein, 346 aa, homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 4460 - protein, 393 aa, homo sapiens [sequence omitted]

SEQ ID NO: 4461 - protein, 261 aa, homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 4462 - protein, 341 aa, homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 4463 - protein, 393 aa, homo sapiens [sequence omitted]

SEQ ID NO: 4464 - protein, 1102 aa, homo sapiens
MFQLPVNNLGSLRKARKTVKKILSDIGLEYCKEHIEDFKQFEPNDFYLKNTTWEDVGLWDPSLTKNQDYRTKPFCCSACPFSSKFFSAYKSHFRNVHSEDFENRILLNCPYCTFNADKKTLETHIKIFHAPNASAPSSSLSTFKDKNKNDGLKPKQADSVEQAVYYCKKCTYRDPLYEIVRKHIYREHFQHVAAPYIAKAGEKSLNGAVPLGSNAREESSIHCKRCLFMPKSYEALVQHVIEDHERIGYQVTAMIGHTNVVVPRSKPLMLIAPKPQDKKSMGLPPRIGSLASGNVRSLPSQQMVNRLSIPKPNLNSTGVNMMSSVHLQQNNYGVKSVGQGYSVGQSMRLGLGGNAPVSIPQQSQSVKQLLPSGNGRSYGLGSEQRSQAPARYSLQSANASSLSSGQLKSPSLSQSQASRVLGQSSSKPAAAATGPPPGNTSSTQKWKICTICNELFPENVYSVHFEKEHKAEKVPAVANYIMKIHNFTSKCLYCNRYLPTDTLLNHMLIHGLSCPYCRSTFNDVEKMAAHMRMVHIDEEMGPKTDSTLSFDLTLQQGSHTNIHLLVTTYNLRDAPAESVAYHAQNNPPVPPKPQPKVQEKADIPVKSSPQAAVPYKKDVGKTLCPLCFSILKGPISDALAHHLRERHQVIQTVHPVEKKLTYKCIHCLGVYTSNMTASTITLHLVHCRGVGKTQNGQDKTNAPSRLNQSPSLAPVKRTYEQMEFPLLKKRKLDDDSDSPSFFEEKPEEPVVLALDPKGHEDDSYEARKSFLTKYFNKQPYPTRREIEKLAASLWLWKSDIASHFSNKRKKCVRDCEKYKPGVLLGFNMKELNKVKHEMDFDAEWLFENHDEKDSRVNASKTADKKLNLGKEDDSSSDSFENLEEESNESGSPFDPVFEVEPKISNDNPEEHVLKVIPEDASESEEKLDQKEDGSKYETIHLTEEPTKLMHNASDSEVDQDDVVEWKDGASPSESGPGSQQVSDFEDNTCEMKPGTWSDESSQSEDARSSKPAAKKKATMQGDREQLKWKNSSYGKVEGFWSKDQSQWKNASENDERLSNPQIEWQNSTIDSEDGEQFDNMTDGVAEPMHGSLAGVKLSSQQA

SEQ ID NO: 4465 - protein, 1102 aa, homo sapiens; identical to SEQ ID NO: 4464

SEQ ID NO: 4466 - protein, 597 aa, homo sapiens
MAEGSAVSDPQHAARLLRALSSFREESRFCDAHLVLDGEEIPVQKNILAAASPYIRTKLNYNPPKDDGSTYKIELEGISVMVMREILDYIFSGQIRLNEDTIQDVVQAADLLLLTDLKTLCCEFLEGCIAAENCIGIRDFALHYCLHHVHYLATEYLETHFRDVSSTEEFLELSPQKLKEVISLEKLNVGNERYVFEAVIRWIAHDTEIRKVHMKDVMSALWVSGLDSSYLREQMLNEPLVREIVKECSNIPLSQPQQGEAMLANFKPRGYSECIVTVGGEERVSRKPTAAMRCMCPLYDPNRQLWIELAPLSMPRINHGVLSAEGFLFVFGGQDENKQTLSSGEKYDPDANTWTALPPMNEARHNFGIVEIDGMLYILGGEDGEKELISMECYDIYSKTWTKQPDLTMVRKIGCYAAMKKKIYAMGGGSYGKLFESVECYDPRTQQWTAICPLKERRFGAVACGVAMELYVFGGVRSREDAQGSEMVTCKSEFYHDEFKRWIYLNDQNLCIPASSSFVYGAVPIGASIYVIGDLDTGTNYDYVREFKRSTGTWHHTKPLLPSDLRRTGCAALRIANCKLFRLQLQQGLFRIRVHSP

SEQ ID NO: 4467 - protein, 123 aa, homo sapiens
MARGSALLLASLLLAAALSASAGLWSPAKEKRGWTLNSAGYLLGPHAVGNHRSFSDKNGLTSKRELRPEDDMKPGSFDRSIPENNIMRTIIEFLSFLHLKEAGALDRLLDLPAAASSEDIERS

SEQ ID NO: 4468 - protein, 294 aa, homo sapiens
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMGFRQNQKEGRCSHSLN

SEQ ID NO: 4469 - protein, 250 aa, homo sapiens
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKIIPPPPPICPDSLDDADALGSMLISWYMSGYHTGYYMEMLA

SEQ ID NO: 4470 - protein, 262 aa, homo sapiens
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKIIPPPPPICPDSLDDADALGSMLISWYMSGYHTGYYMGFRQNQKEGRCSHSLN

SEQ ID NO: 4471 - protein, 294 aa, homo sapiens; identical to SEQ ID NO: 4468

SEQ ID NO: 4472 - DNA, 1515 bp, Artificial Sequence
  Nucleic Acid sequence encoding GRA16
atgtatcgaaaccactcagggatacggcttgcctgcaggctcttcgaagttggagctctcgttttagctttagaaaatgtctctggtattcaccggttcgtcgccgggattgagtggaacgaagggaaagaggattttcagtacacgacgtctccttgggtgattccacctgacggattagtcagtcggcgacttgctgaggaacctcctagaaagcgcttgcgaaaaacaaacaaatcagatcgtgactcagattctgctcaaggttccaggacgacttctcctggcagtctgggcggttttggtgcaacagttgggcgtgttgccactccgcgaatacggagtggtgttgtggcgtcggaggcgatccgaggtacaatttggaggaggccaggtgaagtcgaaagcaccttgaagcttcgtagaaccaggcctcaatattcacaaacagatggagatggcttgcaggggaacaggctttcatcgacaggggaacgatcaggaatatcgcatggggcgcagtctctggcaatgcgcccaaggacaatgggacaaacaatgaaatctttggagagctcatgggattcggatccactcgaaggaacatcacgggattggcaatatgtaccaacgagtgagacagctgcttcgcccggccttaccggccttggagggattggtagaaagtttgcccctctttacgtacgagataggaaatttgacttacttcaatttgtgaatctgacgaggagcaagaaacagaaactcttaatgtcatcaaagagcccctcgctcagaaggctcctcatgaacgacatggcccaggaatgggctctaggaattttgcagatcgcgttgcagggacgacaaagagctctgcaggcttcccacaccacgcgaactacagaacccgcaagtggtactgacggcactagtaaatcgtcggaagacgaagcaacacgcgccagtgagggcaacgcttccgtcaaccagacatcccccgccgcgtcatatccgcgacggccctcttccgacgaagggcaggacagcggacgtagaaagtgttcaaagcgaagtccgtctcgtctcgtacagaacgctcctctttttctgaaggatgatagtcattcactgaaggacacgctggatttagtaaaaaacaagaaccgagagctgacggagaaggggagggtacatgccacccccctgagggtagttttgttaaatagtatcatgatgaagaaacttgagaaggtcttgccagtcgtcgaaagcatggacagagcactgatggctcgtcagacgtcttccgaagcagcgactgtggacgactctagcacttcaatttcacatggtatgcagggtagtaccacctcaggtgcagctgctgtacagggtcccagcacttcagttccaggtgcttcgggaggtcttggtccttcgggggggaagcggaaacccgacgacgaagatgattttgactgttcacgcgcgaagcggaaaaatgatcagatg

SEQ ID NO: 4473 - DNA, 2465 bp, Artificial Sequence
  Nucleic Acid sequence of GRA16_5'UTR
cattttgaaacgtgagcgagtagacagggagtctgcgcatagaactgggcattcgtcctgaccactgttgcatgtgggacgaatcatcagagtatcggaaatgttgatttgataatttgcatctcctcaacatagctgcaaaatagaatgcacgttctataataacgtgcggctctatctacgtatcaggctgtagagagtcaacaacttccttagctacctatctatcagtatgcttatcaacctacctacccaccacatgatgtttgtgcctgagagtcctctacttgtgtccacatttgcggttccccccgtaattattgtttctctcgtatgcagagactagacttatatgcatcattcaccttcgacaacggctgggtatacatgtctggttgtcgcagcacacgctgccacagaggaggttagaaggaagtcgacaccggtcctattatgtactcgccaccgagccaatgcggtgccgtacgtcggagcaataaccaacgtaaccataatgaatacgtatgtatagggaggtcactatatacatatgggacctctccgaacgtcgtacaaggagcacagccatgcacaccaacgcgcaagtagctacactttgatgctagttgctgcattcgcattgtgtcgtttatgctttcatgcgcaaaaatggaagcaagaatcatgccgaatgcctggttctaagtggactgaatgcaaattttggcaagttttacatcattccagagcccttcgttatggacggggctcctgttcgggctgctgggttacgtgactctgtcaggtttgggttaatgtaactagatgaataacgatcgtacacatttggtgggtgggtaggctgctgatggttattttcagcgattaaaacaccactagcgaactcttctgggtacgcacctaccaggcacctgccgaccactcttcacatgccatttatctaaaactttttaaaatagaattatctttgaatatgaggatcgacatcgacaagctcttgtcagcttttgatgagggaaaattatgactggcgattatcccggataacgcaattcgataaatctacggtctaaacatgtgcaccgcctgtccgtgtaaccagcaaacctcaatgtgttttttgttacgcggcgaactggatactttcatccccactcgcagacgtcgaggggggatagcatccgcatgttaacttagtatctgtaagtcaggcggttcacatcggaagtgtacgttgcttgccgttcattgcattcagaatacggaactcatctgaactatttatgcttgtacaggtgatttaatggaaccaaccttgtggcttggcctttcggtgtcaagtggtgggaacctgggcgtctctaaaaggatcacgactgcggtaccgacgatggcactttacaacccgtatcgataaacagatgtttagagtacacatatgttcctgttccagacagacaaatcaacagcgacgcatgaatcaacggtcaacccttgcacgggctatctggcaatcgttctgctacttttcaggtctgacactgctggtatgccggcgcggcgttaatgccgcgttctgacaacaaacgtgtaaactgcttttcagtgccgcagctcacgctttacaaatgacttgactccatcctcgtggaccaagccaacttcttgcgcgcttcgtcgactgatagttagccgttcgccgattgtgcttcggaactaactacataagctcccgctaagaaccccacacggtgtggtgttgttttttgcgacggctgcagaacaggtgcttcttcacaggccccacagggccctttcaaggtggtcacagttttaaggtttcattcttattcccatttcttctgttacaagacggacggtgacagaggagcgtattcatctgtttgccgggttcgcactctgaaccagttggctgttttattcgtcactaataaggccggggctcggatcgccgttcagcgggcttgttggtctgtgtcgactttgtttggcacgcctatttctcgtggcgccgtaaagcaattcaaaggaacgcgtggggcatccgaacgaactcacttttcctgggagtttgttcggcttccggcagatccattgtcattgcttgtctgagcgaggacatccaatccgtgtttctgtgttgtcttagcggctggcttttgtgtcagaaggaatcggagctcgcagcgcgtcggtcaaagctttctgagacgtgttccttacactttggtgcctccatctttatacctgtgtgcgactgctcggcctactgtgaatagtctccgagctgccgtgtcggccgaggcttaaaccgatgctcggatgcctactgaggcacagcagcactgtgcagatactttgagtgaattcgcaagtgtgaattcaccagcaggaatcgtggtagactttgtgcggataccgtc

SEQ ID NO: 4474 - DNA, 27 bp, Artificial Sequence
  Nucleic Acid sequence encoding HA tag
tacccgtacgacgtcccggactacgcg

SEQ ID NO: 4475 - DNA, 693 bp, Artificial Sequence
  Nucleic Acid sequence encoding HXGPRT
atggcgtccaaacccattgaagactacggcaagggcaagggccgtattgagcccatgtatatccccgacaacaccttctacaacgctgatgactttcttgtgcccccccactgcaagccctacattgacaaaatcctcctccctggtggattggtcaaggacagagttgagaagttggcgtatgacatccacagaacttacttcggcgaggagttgcacatcatttgcatcctgaaaggctctcgcggcttcttcaaccttctgatcgactaccttgccaccatacagaagtacagtggtcgtgagtccagcgtgccccccttcttcgagcactatgtccgcctgaagtcctaccagaacgacaacagcacaggccagctcaccgtcttgagcgacgacttgtcaatctttcgcgacaagcacgttctgattgttgaggacatcgtcgacaccggtttcaccctcaccgagttcggtgagcgcctgaaagccgtcggtcccaagtcgatgagaatcgccaccctcgtcgagaagcgcacagatcgctccaacagcttgaagggcgacttcgtcggcttcagcattgaagacgtctggatcgttggttgctgctacgacttcaacgagatgttccgcgacttcgaccacgtcgccgtcctgagcgacgccgctcgcaaaaagttcgagaagtaa

SEQ ID NO: 4476 - DNA, 1506 bp, Artificial Sequence
  Nucleic Acid sequence encoding MeCP2
atggccgccgctgccgccaccgccgccgccgccgccgcgccgagcggaggaggaggaggaggcgaggaggagagactggaggaaaagtcagaagaccaggatctccagggcctcagagacaagccactgaagtttaagaaggcgaagaaagacaagaaggaggacaaagaaggcaagcatgagccactacaaccttcagcccaccattctgcagagccagcagaggcaggcaaagcagaaacatcagaaagctcaggctctgccccagcagtgccagaagcctcggcttcccccaaacagcggcgctccattatccgtgaccggggacctatgtatgatgaccccaccttgcctgaaggttggacacgaaagcttaaacaaaggaagtctggccgatctgctggaaagtatgatgtatatttgatcaatccccagggaaaagcttttcgctctaaagtagaattgattgcatactttgaaaaggtgggagacacctccttggaccctaatgattttgacttcacggtaactgggagagggagcccctccaggagagagcagaaaccacctaagaagcccaaatctcccaaagctccaggaactggcaggggtcggggacgccccaaagggagcggcactgggagaccaaaggcagcagcatcagaaggtgttcaggtgaaaagggtcctggagaagagccctgggaaacttgttgtcaagatgcctttccaagcatcgcctgggggtaagggtgagggaggtggggctaccacatctgcccaggtcatggtgatcaaacgccctggcagaaagcgaaaagctgaagctgacccccaggccattcctaagaaacggggtagaaagcctgggagtgtggtggcagctgctgcagctgaggccaaaaagaaagccgtgaaggagtcttccatacggtctgtgcatgagactgtgctccccatcaagaagcgcaagacccgggagacggtcagcatcgaggtcaaggaagtggtgaagcccctgctggtgtccacccttggtgagaaaagcgggaagggactgaagacctgcaagagccctgggcgtaaaagcaaggagagcagccccaaggggcgcagcagcagtgcctcctccccacctaagaaggagcaccatcatcaccaccatcactcagagtccacaaaggcccccatgccactgctcccatccccacccccacctgagcctgagagctctgaggaccccatcagcccccctgagcctcaggacttgagcagcagcatctgcaaagaagagaagatgccccgaggaggctcactggaaagcgatggctgccccaaggagccagctaagactcagcctatggtcgccaccactaccacagttgcagaaaagtacaaacaccgaggggagggagagcgcaaagacattgtttcatcttccatgccaaggccaaacagagaggagcctgtggacagccggacgcccgtgaccgagagagttagctga

SEQ ID NO: 4477 - DNA, 1506 bp, Artificial Sequence
  Nucleic Acid sequence encoding MECP2_codon_optimized
atggcagcagcggcagcgacggcagcggcagcagcagcacccagcggagggggagggggaggggaagaggaacgacttgaggagaaatctgaagaccaggacctccagggcctgagagacaagcccctcaagttcaagaaggcgaagaaggacaagaaggaagacaaggaaggcaagcacgaacctctgcagccgtctgcccaccactcggccgaaccggccgaagccggcaaggccgagacgtctgaatcttctggaagcgcgcccgccgtgcctgaagcctctgccagccctaagcagcgcagatctatcattcgcgaccgcggacctatgtacgacgaccctaccctccccgagggatggactcgcaagctgaagcagagaaagtctggaagatctgccggaaagtacgacgtctacctcatcaacccgcagggcaaggcgttccgcagcaaggtcgagctcatcgcgtacttcgaaaaagtgggagacacatctctggacccgaacgacttcgacttcaccgtgactggacgcggctctccttcgcgcagagagcagaagccgcctaagaagccgaagtctcctaaggccccgggaacaggaagaggaagaggccgccctaagggatctggaactggacgccctaaggccgccgcctctgaaggagtccaggtgaagcgcgtgctcgagaagtctccgggaaagctggtcgtgaagatgccgttccaggcctctcccggcggaaagggagaaggcggaggcgcgacaacaagcgcgcaggtcatggtcatcaagcgcccgggaagaaagagaaaggccgaggcggaccctcaggccatcccgaagaagcgcggaagaaagcctggatctgtggtggccgccgccgccgccgaggcgaagaagaaggcggtcaaggaaagctctatccgctcggtccacgagacggtgctgcctatcaagaagcgcaagacgcgcgagacagtcagcatcgaggtgaaggaagtcgtgaagcccctcctggtgagcacgctcggcgaaaagtctggcaagggactgaagacatgcaagtctcctggaagaaagtctaaggagtctagccctaagggaagatcttcttctgcctcttcgcccccgaagaaggaacaccatcatcaccaccaccacagcgagtctacaaaggccccgatgcctctcctgccttctcctcccccgcctgagcctgaaagctctgaggaccctatttcgcccccggaacctcaggacctctctagctctatctgcaaggaagagaagatgcctcgcggaggctctctggagtctgacggctgcccgaaggaacctgcgaagacacagccgatggtcgcgaccactacgacagtggcggagaagtacaagcaccgcggcgagggagaacgcaaggacatcgtctcgagctctatgcctagaccaaatagagaagaaccagttgactccagaacgccagtgaccgagcgggtgtcctga

SEQ ID NO: 4478 - DNA, 1237 bp, Artificial Sequence
  Nucleic Acid sequence encoding PARK2
atgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgtaaaggcccctgtcaaagagtgcagccggggaaactcagggtacagtgcagcacctgcaggcaggcaacgctcaccttgacccagggtccatcttgctgggatgatgttttaattccaaaccggatgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtgggaactggagacacagtggtgcttagaggagctctggggggattcaggagaggagtcgctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtatggacaacgaagaacaaaataagctgcctcagggagaagtgagtgcctcattcaatacatcgttcaaggaaaagtcattggtagcaaagctatag

SEQ ID NO: 4479 - DNA, 885 bp, Artificial Sequence
  Nucleic Acid sequence encoding SMN1
atggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgagaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaa

SEQ ID NO: 4480 - DNA, 33 bp, Artificial Sequence
  Nucleic Acid sequence encoding TAT
tatggacggaagaagcggcgacagcgacgacga

SEQ ID NO: 4481 - DNA, 735 bp, Artificial Sequence
  Nucleic Acid sequence encoding Toxofilin
atggcgcaatacaagtcacgccctttggcagcttttctgctgctcattaccgtcggatcgctgctgaccgcatccgaatcggtccagctttctgaaggcatgaagaggctcagcatgagaggaagaagtcccagcccgaaaaggggaagattcgagagtggagacgaagggacatctacaatgtcgccctccgtcgcagcacgccaacaggaactagggctgctccgtccggaagagaggctcattgcgggtcaagccaaagcagcggcgctacagactgtccatcaattaggagcagttgctcttaccccagagcaagctaaagccgcactgctagacgaaattctcagagccacgcaaaatttggacctcaggaagtacgagaatctcaacacggagcaacaaaaggcctatgaacaagtccagagggatctttcgcaactgagtccggaaacgaaggctttgctcattgaaaatcagaggaaggagaaaaccctacttgaaaaggcgagaaagctcttccaaagacgccactaccacgttaccaagcaggcggctttggctggacaaatcctcaacgagcagagggatgcgagtggagcattacaatcaggtgctgtgaagactgcgatccaaagagccaacgagcagtacaacgtcgctgaggaagacaagaactttaacgaggaacagcatgcatcacaactgaaaaaggtaggcgctatgccctcgtcg

SEQ ID NO: 4482 - DNA, 1116 bp, Artificial Sequence
  Nucleic Acid sequence of Toxofilin_5'UTR
atcaagcttgtgctcggttccatatgttagaagcgaactctccgcctcaatttttcttttctttggacttcggtggtcggcactgacgctttgctagccctcgcctttggcgacattcagcacccttgtctggaccaagccctttccccacgagcacagccgactggcaccagacgagtgtatggtatctctacgaaacacagcacgccgttactcctcgaggaaagagacacttttaaagaacagagaaaacgtctcgagaagattctgcgggcggcttcaccgctgctgcctttctgcgccatttagaacaaggtgttcgccacctcgtttatggcttatccggccttctgcttcaaaaggaaaggcgacccctgctagcgaccagtcttgtttctttgccaagaggcacctgcacgtcaaaacccaaacatcatttgctcggggtaaaatctgtcgcggactgtctacagcaaatacgctgctttctctgaaacaccagcgaccttgacaagccacacgcgggtcgccctagaccggctgtctgcgagtctgcaaacggcagttagccgaagcgaaaaaccaatcaggcacagcgctggactcggggcaccggtttcggtcagggccccgaaagaacccgtttcgtggcctgtgtcttttctctgctcgaagacgctagctgtgcttgtgtcttgcgctacctgcggcccctctaaatgtctgcccgcaactgctagctgctggtctcgttgaccgttgccgacaagatccacgagagcggcgacaacgagcataccagacccgaaggcaggagcggaatccgagcaaagacacctgtcaaaaataatccttttttatcttggactcggccggatctgtgtgtcttgcaaccactgcttcgcatagcgctgtcccgacatcccgcagcgccaaccgtaccacagtgttacttctgccagctagttattgcgcagtctcggccaggagccgcaaacagcgcgctggcggattcgcatttctatttccgggaattccaagtcaagacgcatgtcaagtgaccaaggcgtcgacgcgtcgaactctgtgaaagccttccacttgtaactggtcaac

SEQ ID NO: 4483 - DNA, 942 bp, Artificial Sequence
  Nucleic Acid sequence encoding ASPA
atgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttggcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcctcagcctcaaggggttctgagagctgatatcttggatcaaatgagaaaaatgattaaacatgctcttgattttatacatcatttcaatgaaggaaaagaatttcctccctgcgccattgaggtctataaaattatagagaaagttgattacccccgggatgaaaatggagaaattgctgctatcatccatcctaatctgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattag

SEQ ID NO: 4484 - DNA, 1833 bp, Artificial Sequence
  Nucleic Acid sequence encoding DHFR-TS_cDNA
atgcagaaaccggtgtgtctggtcgtcgcgatgacccccaagaggggcatcggcatcaacaacggcctcccgtggccccacttgaccacagatttcaaacacttttctcgtgtgacaaaaacgacgcccgaagaagccagtcgcctgaacgggtggcttcccaggaaatttgcaaagacgggcgactctggacttccctctccatcagtcggcaagagattcaacgccgttgtcatgggacggaaaacctgggaaagcatgcctcgaaagtttagacccctcgtggacagattgaacatcgtcgtttcctcttccctcaaagaagaagacattgcggcggagaagcctcaagctgaaggccagcagcgcgtccgagtctgtgcttcactcccagcagctctcagccttctggaggaagagtacaaggattctgtcgaccagatttttgtcgtgggaggagcgggactgtacgaggcagcgctgtctctgggcgttgcctctcacctgtacatcacgcgtgtagcccgcgagtttccgtgcgacgttttcttccctgcgttccccggagatgacattctttcaaacaaatcaactgctgcgcaggctgcagctcctgccgagtctgtgttcgttcccttttgtccggagctcggaagagagaaggacaatgaagcgacgtatcgacccatcttcatttccaagaccttctcagacaacggggtaccctacgactttgtggttctcgagaagagaaggaagactgacgacgcagccactgcggaaccgagcaacgcaatgagctccttgacgtccacgagggagacaactcccgtgcacgggttgcaggctccttcttcggccgcagccattgccccggtgttggcgtggatggacgaagaagaccggaaaaaacgcgagcaaaaggaactgattcgggccgttccgcatgttcactttagaggccatgaagaattccagtaccttgatctcattgccgacattattaacaatggaaggacaatggatgaccgaacgggcgttggtgtcatctccaaattcggctgcactatgcgctactcgctggatcaggcctttccacttctcaccacaaagcgtgtgttctggaaaggggtcctcgaagagttgctgtggttcattcgcggcgacacgaacgcaaaccatctttctgagaagggcgtgaagatctgggacaagaatgtgacacgcgagttcctcgattcgcgcaatctcccccaccgagaggtcggagacatcggcccgggctacggcttccagtggagacacttcggcgcggcatacaaagacatgcacacagactacacagggcagggcgtcgaccagctgaagaatgtgatccagatgctgagaacgaatccaacagatcgtcgcatgctcatgactgcctggaatcctgcagcgctggacgaaatggcgctgccgccttgtcacttgttgtgccagttctacgtgaacgaccagaaggagctgtcgtgcatcatgtatcagcggtcgtgcgatgtcggcctcggcgtccccttcaacatcgcttcctattcgcttttgacgctcatggttgcacacgtctgcaacctaaaacctaaggagttcattcacttcatggggaacacgcatgtctacacgaaccatgtcgaggctttaaaagagcagctgcggagagaaccgagaccgttccccattgtgaacatcctcaacaaggaacgcatcaaggaaatcgacgatttcaccgccgaggattttgaggtcgtgggctacgtcccgcacggacgaatccagatggagatggctgtctag

SEQ ID NO: 4485 - DNA, 8399 bp, Artificial Sequence
  Nucleic Acid sequence of DHFR-TS_genomic
aagcttcgccaggctgtaaatcccgtgagtcgtcctcacaaatcatcaagcaggtgtcctcagggagactgcctgactgagttatgctaattcctttctactttggcgtggtcacgtgtaaccatatccgaatcatttctctagccctacgaacaggtaagagcgctagggatgtccgtggagtagtgtgcttactcgataatattcagttgggactaccagcgaggcgctcgctttgctcacgcaatgcctgagacagttgcagaatgaatggtaaccgacaaacgcgttcatatgcgttttcaaacttagtagacgcgtactgtctgaaactggcggtcacaggcaccagataacgcccttggcatcggcatgtctcgtacagaggtccgtatgtagtgccacgacttctaaatccggcgacaggctggtcttttgtcttaccacgtattagcccgcgtgcgatttctcggagcgcacctgttcaacactagaaaacggagtttcctgatcgagaagccaccacctttccagaagttgaacgctagcatgtcattcgattttcaccccccgcgtagttcctgtgtgtcattcgttgtcgagacaactctgtcccgccccggtgctgttccatatgcgtgactttcccgcaattttttcagactttcaggaaagacaggctccggaacgatctcgtccatgactggtaaatccacgacaccgcaatggcccccagcacctctatctctcgtgccaggggactaacgttgtatgcgtctgcgtcttgtctttttgcattcgctttccaaaaaagagagccatccgttcccccgcacattcaacgccgcgagtgcggtttttgtcttttttgagtggtaggacgcttttcatgcgcgaactacgtggacattaagttccattctctttttcgacagcacgaaaccttgcattcaaacccgcccgcggaagatccgatcttgctgctgttcgcagtcccagtagcgtcctgtcggccgcgccgtctctgttggtgggcagccgctacacctgttatctgactgccgtgcgcgaaaatgacgccatttttgggaaaatcggggaacttcattctttaaaagtatgcggaggtttcctttttcttctgttcgtttctttttctcgggtttgataaccgtgttcgatgtaagcactttccgtctctcctccgtgctttgttcgacatcgagaccaggtgtgcagatccttcgcttgtcgatccggagacgcgtgtctcgtagaaccttttcattttaccacacggcagtgcggagcactgctctgagtgcagcagggacgggtgaagtttcgctttagtagtgcgtttctgctctacggggcgttgtcgtgtctgggaagatgcagaaaccggtgtgtctggtcgtcgcgatgacccccaagaggggcatcggcatcaacaacggcctcccgtggccccacttgaccacagatttcaaacacttttctcgtgtgacaaaaacgacgcccgaagaagccagtcgcctgaacgggtggcttcccaggaaatttgcaaagacgggcgactctggacttccctctccatcagtcggcaagagattcaacgccgttgtcatgggacggaaaacctgggaaagcatgcctcgaaagtttagacccctcgtggacagattgaacatcgtcgtttcctcttccctgtgagcacacacagtagtcgccacacgctgtttgagacgtgtcaatctccaagagtgtggacgctgttccacgtcttcaaatgtttcccaacatccgtcgtctagtagacacaccaacaaaaagcacacggcgaatctgctcatcggagggaggagccggggggcacacaactatcctcaactctcgaacgaacatatccggggccgcgaagacgtccagtctctcaaatccaacccggaacgcaaacatttctgcatcaagtcacgattgcgccggtacctccatgtgtaagcagttccatgaaacctccgatattacacacgactgtggatatgaattatatgcagatgcatatatactgagacgccgatgcaactataggtttcctggccctccatggatatttcagaccttcctctcacatttggtttgcccgtacacctccgttacgctttttttctggctttcttcttcgtctctgtttatcagcaaagaagaagacattgcggcggagaagcctcaagctgaaggccagcagcgcgtccgagtctgtgcttcactcccagcagctctcagccttctggaggaagagtacaaggattctgtcgaccagatttttgtcgtgggtatgttgtcctaaactccttggaactccattcttggtcagaaacgtactgaaactgtatacatgtatatacagatgtatggataatatctagagaagatacagggaagactggcaaggatgaaaagacatgcagctttaacgaagcagagggcattggcgagagggacgcccgttatgctgtgtgatgtggctgtgaatcttacctcgccgtttgacttgctgcagcgctttgtccacttgaacgtgacttcttgtttctaccttccccaacgccttctattcccttcactgcgaaagcgcgctcagtgggccgtcaccgaacacccttggttctttcgttcagctgttgtcctctttctcgcgttgcttcctgtggcgtcgtggctcggcttctctctctttcctgttggtgcgtccagactatgtcgcctgtttccccacccttctcggcttgtgctttcaggaggagcgggactgtacgaggcagcgctgtctctgggcgttgcctctcacctgtacatcacgcgtgtagcccgcgagtttccgtgcgacgttttcttccctgcgttccccggagatgacattctttcaaacaaatcaactgctgcgcaggctgcagctcctgccgagtctgtgttcgttcccttttgtccggagctcggaagagagaaggacaatgaagcgacgtatcgacccatcttcatttccaagaccttctcagacaacggggtaccctacgactttgtggttctcgagaagagaaggaagactgacgacgcagccactgcggaaccggtaagaggcaaccgaagcgcgtagataagaaaaacaacaaagagaaggtgaaacacgaagagaagggaaaatgcggagaaaccgtggatttacaaagatatcaagagcaatgctttgtggagattttttttaattcagtagagacacccgccgtgcgaggtgtgtagaaataactgcgaccctggagacagagatgccgcgagtacaccacttgtcgtttttcctcctatgttcatgacgggtgctgaacgtctatcgtacttaattggaggagtcgtctccgaagcagctttggctggccatccgtgtgtttgccttgttcctgaaaagccagaaggcgctccacagtgaggcgatatacagggacgcctaccggagccccgttttctgcctttgtcgactcttgcagagcaacgcaatgagctccttgacgtccacgagggagacaactcccgtgcacgggttgcaggctccttcttcggccgcagccattgccccggtgttggcgtggatggacgaagaagaccggaaaaaacgcgagcaaaaggaactgattcgggccgttccgcatgttcactttagaggccatgaagaattccagtaccttgatctcattgccgacattattaacaatggaaggacaatggatgaccgaacgggtaacggcgactgcgagaaaaagccacaccgttttctcctgtgattctgtccgcaagccctcttttgcttcatccaccctttgctattctccgccgccttccttttctgctccatgttcaattcgttcgcttcttcagtctttccatcttcccctgttacctctgtcattcgttttcttgcctctatttaactgtgttctactcacagtctgcattccgcgatagacgagcttccacgtcttgcgtctcgacaagcaactgtcatttgtacgcgcctccctccaccgtgaatcggattgtcggttcgccggttcctgggtcagaaaaggcctgcgccagtattctgaataatacccttcgccattgtaaagaggcgaaggaacaaagagatatttcggcgcatcttttgtgcggcgcgtttcctcgtgcttcacaccgatgcccttctgtgcatgtcttctgctcctcgtccttctctctttttccctgtttaggcgttggtgtcatctccaaattcggctgcactatgcgctactcgctggatcaggcctttccacttctcaccacaaagcgtgtgttctggaaagggtaagggcgtcttcagtgaatgcatatatttgacttcagacattcttaactgtttgacaaccaacgtacaaatttgtttgtccgtgtgcgtgttcgacatgtcaagtatgtgaagagtcgctactgtagactaacgcacgaaccagatttgtttatctgcatgcgctgtgcacccgtttctgagtgtctggagtttccgcaaccttcctttgaatttctgggttcgtttttttatgcgcgcactggtttgcatgtggcctgagagagcacagatcgaaggtggggtgatgtggcgtcgctgcagagaaactccggcgaaggcgacagataaaggagagtggaaatcattgaacagtgtcggtcgtctgttgtttcgcagggtcctcgaagagttgctgtggttcattcgcggcgacacgaacgcaaaccatctttctgagaagggcgtgaaggcaagtctacgttgtacctcttgtctctgccgaagctcagatgtctccacggcgttggtttcttttcgtttttgctttcgtggcattaccatcgagtcaccactcatagttgcgtgtgtctacatgttttctagaacgtccgttgtgttgcctcgtggcgaccggcgcgagtgtatgtaccctgcgctgtcagaagttgatccttacgctgctaatgggatcgtttagaccttcccatagcactgactttcttcttcgcatgttccactctgtgcgttcgtgtccgtggcgtcgtctgctctgtgaaaacgcgtctcgatgcgcaaccgcacaaagtaggggcgtacgtcagcagattctcatgcctgttgatcgccgtggtgttggtgcctgctcgtcttagatctgggacaagaatgtgacacgcgagttcctcgattcgcgcaatctcccccaccgagaggtcggagacatcggcccgggctacggcttccagtggagacacttcggcgcggcatacaaagacatgcacacagactacacaggtatatgccggcaatgtgtgcagggaaggggcacaagcggaagaactctggcgcaacagcacctggctgaatcgtggtttgcctcaggtgcagatccggccattttaaaacgcaagttccatcagacgcggacaggaaatgacataacagacatatacatgtacgacgcagtgctccctctcatcctgagacggatgtcaaggtggacgaaagccggttatggcctcatctggtgatgtagactcgcccatcccgtgatccctccaggcgtcggtgtttgtatgctgttttctggaaccttttacacctgcgttcacacatgtctgcgcagatgcacagcgtcaggggcctggagaagaaagacgtccagcaattcgtttctcacatgtgttctttgcagggcagggcgtcgaccagctgaagaatgtgatccagatgctgagaacgaatccaacagatcgtcgcatgctcatgactgcctggaatcctgcaggtgagccttgcgtgtcgttcatctgtctattgtctcaggtgcccatgcatgcgttttaacctcatgttttctctgcatttgtgccgtctctgcgtcttcacatgggaaaggcacaagagcagccgtggttgagtacaaacgacctcagtctacttccattttgcagctctcgcaaacgatgtcgcgtgtttgtacccgcaacgcctctctgtcttgcatccattttgcgtctttcttggtgtctgtatgcctagtagtctgtcagttcccgcgcgcaggctgcaccccgcctttcattgctcgcagcgtttgcccccggttagtactcgtgtgtgttccctggatctctctgcacatggccattccgttgttttgccattccgccgccgttgcttcgtccgcccccgctttctcagcgcctttcttccctctcgtgccttgcctacctaccagcgtcttccctattttatcgccgaggtgctcgcgttttctgcgttggctgcgctcgatcgcagttcgcgtcacgtcttcgtcgaatctgggacttcgagccacggcgatggtggcgcctccgcgtgttttctctcaccgtgcacatttctccacgctgttgcttttgcgttcagcgctggacgaaatggcgctgccgccttgtcacttgttgtgccagttctacgtgaacgaccagaaggagctgtcgtgcatcatgtatcagcggtcgtgcgatgtcggcctcggcgtccccttcaacatcgcttcctattcgcttttgacgctcatggttgcacacgtctgcaacctaaaacctaaggagttcattcacttcatggggaacacgcatgtctacacgaaccatgtcgaggctttaaaagagcagctgcggagagaaccgagaccgttccccattgtgaacatcctcaacaaggaacgcatcaaggtgagcacaagttgcaaaggaaaaacgacagtcgatgccagcagaagaaggacgcgcaggggagactgcagctctgcgccgctgcctcgactcggcctatagtcagaaaggcaggggtgcaacgtggaagaaaggtcaaggtaaaggtggaaaacccatttgctcggaatgccttacctccgtggctcgagggggaacgcgaacaatagaggaaactggtgcagttagcgcgggcaactgctaaagaatgttcaagaatgcttctgtctccacgcgattgtgaggacgtctgagcgtttttctgtgtttgcttctcgtgtttcgcgggtgtgttgtgccattttcggtggcagcgcacatgtatctgatccccagaatacggaaaagaagcaatcacacgaagttttgtatcatccggcggatttggcgttagacctgacagcaacggccataggtttctcgcgtgtgttcggcgcttcgatggcccaaagagctcgcatggtgccgcgtttctatggattcgtttaccaggaaatcgacgatttcaccgccgaggattttgaggtcgtgggctacgtcccgcacggacgaatccagatggagatggctgtctagcggaaatacagaagctgcccgtctctcgttttcctctcttttcggagggatcagggagagtgcctcgggtcggagagagctgacgagggggtgccagagacccctgtgtcctttatcgaagaaaagggatgactcttcatgtggcatttcacacagtctcacctcgccttgttttctttttgtcaatcagaacgaaagcgagttgcgggtgacgcagatgtgcgtgtatccactcgtgaatgcgttatcgttctgtatgccgctagagtgctggactgttgctgtctgcccacgacagcagacaactttccttctatgcacttgcaggatggtgcagcgcaaacgacggagagaaaggagcaccctctcagtttccctacgatgtgctgtcagtttcgactcttcaccgcgaacgattggcgatacgtctctgttgacttgttaggctccgaccacgaagctcccttaactaaataagccgcgacacctaagtgtacaccatttgcagatcgataatctgcgaccgctgaatccgtccagatcagtaaaaccgcaccacctaagtgtaaaccttgtttaggtcgataaaatgctaccaacccccacccacaatcgagccttgagcgtttctgcgcacgcgttggcctacgtgacttgctgatgcctgcctctggccattcatgccagtcagtgcgcataaaaatgtggacacagtcggttgacaagtgttctggcaggctacagtgacacggggaaatcgtttctgagagagcaccaaaaccttttagctgtcaccatcttcttcgcttgctacgttgtctgatttgtcgtttttcctctcggtgtgaagcgtttttcgtaacgtcaatcgacccaggacactgcttccagctgtctgtgccgtcctgtcgtgaccagtttgtcgccgcgactttatgagctttttcctgttgagaaagcggttcggcggccgc

SEQ ID NO: 4486 - DNA, 2010 bp, Artificial Sequence
  Nucleic Acid sequence encoding GALC
atgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagatggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactacaaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaa

SEQ ID NO: 4487 - DNA, 1925 bp, Artificial Sequence
  Nucleic Acid sequence encoding mutated GALC-TAT
atgactgcggcggcggggcaacctcccgacttctagtaaattacccagagccctatcgttctcagatattggattatctctttaagccgaattttggtgcctctttgcatattttaaaagtggaaataggtggtgatgggcagacaacagatggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactacaaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgcggcggtggcggttatggacggaagaagcggcgacagcgacgacgataa

SEQ ID NO: 4488 - DNA, 2055 bp, Artificial Sequence
  Nucleic Acid sequence encoding GALC-TAT
atgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagatggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactacaaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgcggcggtggcggttatggacggaagaagcggcgacagcgacgacgataa

SEQ ID NO: 4489 - DNA, 609 bp, Artificial Sequence
  Nucleic Acid sequence encoding GDNF
atgaagttatgggatgtcgtggctgtctgcctggtgctgctccacaccgcgtccgccttcccgctgcccgccgaagaccgctccctcggccgccgccgcgcgcccttcgcgctgagcagtgactcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 4490 - DNA, 12 bp, Artificial Sequence
  Nucleic Acid sequence of Gly_linker
ggcggtggcggt

SEQ ID NO: 4491 - DNA, 428 bp, Artificial Sequence
  Nucleic Acid sequence of GRA2_3'UTR
ttaattaagactacgacgaaagtgatgcgcaggctggaaagccgctgaagggagaagtctacaaagccgatcagtgaaaaatgtgtggggaggtggtcttgttgcaggaatgcaatggtgttaagcatcgtgttcgaatgcagtgcgtgtatcagttgtgcgcggaaggacactgcttcaatgttaagaacctgttttctccgtagagaggaccaaaagacgattgcaaaactggtatgtacgcaatagcccaatgccggacgtcagttggttgtatgtgacgctcccagatgtcatatgccttgtgagtgtgtctgggatgcaagtttttggtgtgcgttgatttcgccagcttatgacagtggcagacgaattattgacatgatacaaggacgcagaaaggaacaaacaccgtagttccagtcgac

SEQ ID NO: 4492 - DNA, 451 bp, Artificial Sequence
  Nucleic Acid sequence of DHFR-TS_5'UTR
cagcacgaaaccttgcattcaaacccgcccgcggaagatccgatcttgctgctgttcgcagtcccagtagcgtcctgtcggccgcgccgtctctgttggtgggcagccgctacacctgttatctgactgccgtgcgcgaaaatgacgccatttttgggaaaatcggggaacttcattctttaaaagtatgcggaggtttcctttttcttctgttcgtttctttttctcgggtttgataaccgtgttcgatgtaagcactttccgtctctcctccgtgctttgttcgacatcgagaccaggtgtgcagatccttcgcttgtcgatccggagacgcgtgtctcgtagaaccttttcattttaccacacggcagtgcggagcactgctctgagtgcagcagggacgggtgaagtttcgctttagtagtgcgtttctgctctacggggcgttgtc

SEQ ID NO: 4493 - DNA, 743 bp, Artificial Sequence
  Nucleic Acid sequence of DHFR-TS_3'UTR
acagaagctgcccgtctctcgttttcctctcttttcggagggatcagggagagtgcctcgggtcggagagagctgacgagggggtgccagagacccctgtgtcctttatcgaagaaaagggatgactcttcatgtggcatttcacacagtctcacctcgccttgttttctttttgtcaatcagaacgaaagcgagttgcgggtgacgcagatgtgcgtgtatccactcgtgaatgcgttatcgttctgtatgccgctagagtgctggactgttgctgtctgcccacgacagcagacaactttccttctatgcacttgcaggatggtgcagcgcaaacgacggagagaaaggagcaccctctcagtttccctacgatgtgctgtcagtttcgactcttcaccgcgaacgattggcgatacgtctctgttgacttgttaggctccgaccacgaagctcccttaactaaataagccgcgacacctaagtgtacaccatttgcagatcgataatctgcgaccgctgaatccgtccagatcagtaaaaccgcaccacctaagtgtaaaccttgtttaggtcgataaaatgctaccaacccccacccacaatcgagccttgagcgtttctgcgcacgcgttggcctacgtgacttgctgatgcctgcctctggccattcatgccagtcagtgcgcataaaaatgtggacacagtcggttgacaagtgttctggcaggctacagtgacac

SEQ ID NO: 4494 - DNA, 102 bp, Artificial Sequence
  Nucleic Acid sequence  of TALE Monomer templates pNN
ctcaccccagagcaggtcgtggcaattgcgagcaacaacgggggaaagcaggcactcgaaaccgtccagaggttgctgcctgtgctgtgccaagcgcacgga

SEQ ID NO: 4495 - DNA, 102 bp, Artificial Sequence
  Nucleic Acid sequence of TALE Monomer templates pHD
ctcaccccagagcaggtcgtggcaattgcgagccatgacgggggaaagcaggcactcgaaaccgtccagaggttgctgcctgtgctgtgccaagcgcacgga

SEQ ID NO: 4496 - DNA, 3782 bp, Artificial Sequence
  Nucleic Acid sequence of pTALE-TF (NI)
atgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgacagagaccgcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgacggtctcgactcacgcctgagcaggtagtggctattgcatccaatatcgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaggcagtggagagggcagaggaagtctgctaacatgcggtgacgtcgaggagaatcctggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4497 - DNA, 3782 bp, Artificial Sequence
  Nucleic Acid sequence of pTALE-TF (NG)
atgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgacagagaccgcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgacggtctcgactcacgcctgagcaggtagtggctattgcatccaatggcgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaggcagtggagagggcagaggaagtctgctaacatgcggtgacgtcgaggagaatcctggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4498 - DNA, 3782 bp, Artificial Sequence
  Nucleic Acid sequence of pTALE-TF (NN)
atgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgacagagaccgcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgacggtctcgactcacgcctgagcaggtagtggctattgcatccaataacgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaggcagtggagagggcagaggaagtctgctaacatgcggtgacgtcgaggagaatcctggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4499 - DNA, 3782 bp, Artificial Sequence
  Nucleic Acid sequence of pTALE-TF (HD)
atgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgacagagaccgcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgacggtctcgactcacgcctgagcaggtagtggctattgcatcccatgacgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaggcagtggagagggcagaggaagtctgctaacatgcggtgacgtcgaggagaatcctggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4500 - DNA, 2855 bp, Artificial Sequence
  Nucleic Acid sequence of pTALEN (NI)
atggactataaggaccacgacggagactacaaggatcatgatattgattacaaagacgatgacgataagatggccccaaagaagaagcggaaggtcggtatccacggagtcccagcagccgtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgacagagaccgcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgacggtctcgactcacgcctgagcaggtagtggctattgcatccaacatcgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcaggttcccaactcgtgaagagtgaacttgaggagaaaaagtcggagctgcggcacaaattgaaatacgtaccgcatgaatacatcgaacttatcgaaattgctaggaactcgactcaagacagaatccttgagatgaaggtaatggagttctttatgaaggtttatggataccgagggaagcatctcggtggatcacgaaaacccgacggagcaatctatacggtggggagcccgattgattacggagtgatcgtcgacacgaaagcctacagcggtgggtacaatcttcccatcgggcaggcagatgagatgcaacgttatgtcgaagaaaatcagaccaggaacaaacacatcaatccaaatgagtggtggaaagtgtatccttcatcagtgaccgagtttaagtttttgtttgtctctgggcatttcaaaggcaactataaggcccagctcacacggttgaatcacattacgaactgcaatggtgcggttttgtccgtagaggaactgctcattggtggagaaatgatcaaagcgggaactctgacactggaagaagtcagacgcaagtttaacaatggcgagatcaatttccgctcataa

SEQ ID NO: 4501 - DNA, 2855 bp, Artificial Sequence
  Nucleic Acid sequence of pTALEN (NG)
atggactataaggaccacgacggagactacaaggatcatgatattgattacaaagacgatgacgataagatggccccaaagaagaagcggaaggtcggtatccacggagtcccagcagccgtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgacagagaccgcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgacggtctcgactcacgcctgagcaggtagtggctattgcatccaacggagggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcaggttcccaactcgtgaagagtgaacttgaggagaaaaagtcggagctgcggcacaaattgaaatacgtaccgcatgaatacatcgaacttatcgaaattgctaggaactcgactcaagacagaatccttgagatgaaggtaatggagttctttatgaaggtttatggataccgagggaagcatctcggtggatcacgaaaacccgacggagcaatctatacggtggggagcccgattgattacggagtgatcgtcgacacgaaagcctacagcggtgggtacaatcttcccatcgggcaggcagatgagatgcaacgttatgtcgaagaaaatcagaccaggaacaaacacatcaatccaaatgagtggtggaaagtgtatccttcatcagtgaccgagtttaagtttttgtttgtctctgggcatttcaaaggcaactataaggcccagctcacacggttgaatcacattacgaactgcaatggtgcggttttgtccgtagaggaactgctcattggtggagaaatgatcaaagcgggaactctgacactggaagaagtcagacgcaagtttaacaatggcgagatcaatttccgctcataa

SEQ ID NO: 4502 - DNA, 2855 bp, Artificial Sequence
  Nucleic Acid sequence of pTALEN (NN)
atggactataaggaccacgacggagactacaaggatcatgatattgattacaaagacgatgacgataagatggccccaaagaagaagcggaaggtcggtatccacggagtcccagcagccgtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgacagagaccgcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgacggtctcgactcacgcctgagcaggtagtggctattgcatccaacaacgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcaggttcccaactcgtgaagagtgaacttgaggagaaaaagtcggagctgcggcacaaattgaaatacgtaccgcatgaatacatcgaacttatcgaaattgctaggaactcgactcaagacagaatccttgagatgaaggtaatggagttctttatgaaggtttatggataccgagggaagcatctcggtggatcacgaaaacccgacggagcaatctatacggtggggagcccgattgattacggagtgatcgtcgacacgaaagcctacagcggtgggtacaatcttcccatcgggcaggcagatgagatgcaacgttatgtcgaagaaaatcagaccaggaacaaacacatcaatccaaatgagtggtggaaagtgtatccttcatcagtgaccgagtttaagtttttgtttgtctctgggcatttcaaaggcaactataaggcccagctcacacggttgaatcacattacgaactgcaatggtgcggttttgtccgtagaggaactgctcattggtggagaaatgatcaaagcgggaactctgacactggaagaagtcagacgcaagtttaacaatggcgagatcaatttccgctcataa

SEQ ID NO: 4503 - DNA, 2855 bp, Artificial Sequence
  Nucleic Acid sequence of pTALEN (HD)
atggactataaggaccacgacggagactacaaggatcatgatattgattacaaagacgatgacgataagatggccccaaagaagaagcggaaggtcggtatccacggagtcccagcagccgtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgacagagaccgcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgacggtctcgactcacgcctgagcaggtagtggctattgcatcccatgacgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcaggttcccaactcgtgaagagtgaacttgaggagaaaaagtcggagctgcggcacaaattgaaatacgtaccgcatgaatacatcgaacttatcgaaattgctaggaactcgactcaagacagaatccttgagatgaaggtaatggagttctttatgaaggtttatggataccgagggaagcatctcggtggatcacgaaaacccgacggagcaatctatacggtggggagcccgattgattacggagtgatcgtcgacacgaaagcctacagcggtgggtacaatcttcccatcgggcaggcagatgagatgcaacgttatgtcgaagaaaatcagaccaggaacaaacacatcaatccaaatgagtggtggaaagtgtatccttcatcagtgaccgagtttaagtttttgtttgtctctgggcatttcaaaggcaactataaggcccagctcacacggttgaatcacattacgaactgcaatggtgcggttttgtccgtagaggaactgctcattggtggagaaatgatcaaagcgggaactctgacactggaagaagtcagacgcaagtttaacaatggcgagatcaatttccgctcataa

SEQ ID NO: 4504 - DNA, 102 bp, Artificial Sequence
  Nucleic Acid sequence of TALE NH monomer
ctgaccccagagcaggtcgtggcaattgcgagcaaccacgggggaaagcaggcactcgaaaccgtccagaggttgctgcctgtgctgtgccaagcgcacgga

SEQ ID NO: 4505 - DNA, 8 bp, Artificial Sequence
  Nucleic Acid sequence of target sequence
tacgtacg

SEQ ID NO: 4506 - DNA, 7098 bp, Artificial Sequence
  Nucleic Acid sequence of TALE_Nuc_TACGTACG
  misc_feature (2)..(805): pUC_ori
  misc_feature (1454)..(2054): CMV_Promoter
  misc_feature (2113)..(2232): NLS
  misc_feature (2233)..(2640): TAL_N-Term
  misc_feature (2641)..(2742): Tandem_Repeats    "Repeat 1: NI"
  misc_feature (2743)..(2844): Tandem_Repeats   "Repeat 2: HD"
  misc_feature (2845)..(2946): Tandem_Repeats   "Repeat 3: NN"
  misc_feature (2947)..(3048): Tandem_Repeats   "Repeat 4: NG"
  misc_feature (3049)..(3150): Tandem_Repeats  "Repeat 5: NI"
  misc_feature (3151)..(3252): Tandem_Repeats  "Repeat 6: HD"
  misc_feature (3253)..(3312): Half_Repeat
  misc_feature (3313)..(3501): TAL_C-term
  misc_feature (3502)..(4104): Fok1
  misc_feature (4342)..(4685): SV40_ori
  misc_feature (4731)..(5756): Hygromycin
  misc_feature (5884)..(6014): SV40_pA_Signal
  misc_feature (6069)..(6917): Ampicillin  (complement strand)
ctcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaggcgagagtagggaactgccaggcatcaaactaagcagaaggcccctgacggatggcctttttgcgtttctacaaactctttctgtgttgtaaaacgacggccagtcttaagctcgggccccctgggcggttctgataacgagtaatcgttaatccgcaaataacgtaaaaacccgcttcggcgggtttttttatggggggagtttagggaaagagcatttgtcagaatatttaagggcgcctgtcactttgcttgatatatgagaattatttaaccttataaatgagaaaaaagcaacgcactttaaataagatacgttgctttttcgattgatgaacacctataattaaactattcatctattatttatgattttttgtatatacaatatttctagtttgttaaagagaattaagaaaataaatctcgaaaataataaagggaaaatcagtttttgatatcaaaattatacatgtcaacgataatacaaaatataatacaaactataagatgttatcagtatttattatcatttagaataaattttgtgtcgcccttaattgtgagcggataacaattacgagcttcatgcacagtggcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataggggccaccatggactataaggaccacgacggagactacaaggatcatgatattgattacaaagacgatgacgataagatggccccaaagaagaagcggaaggtcggtatccacggagtcccagcagccgtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgaccccagagcaggtcgtggcaattgcgagcaacatcgggggaaagcaggcactcgaaaccgtccagaggttgctgcctgtgctgtgccaagcgcacggactaaccccagagcaggtcgtggcaattgcgagccatgacgggggaaagcaggcactcgaaaccgtccagaggttgctgcctgtgctgtgccaagcgcacggattgaccccagagcaggtcgtggcaattgcgagcaacaacgggggaaagcaggcactcgaaaccgtccagaggttgctgcctgtgctgtgccaagcgcacgggctgaccccagagcaggtcgtggcaattgcgagcaacggagggggaaagcaggcactcgaaaccgtccagaggttgctgcctgtgctgtgccaagcgcacggcctgacaccagagcaggtcgtggcaattgcgagcaacatcgggggaaagcaggcactcgaaaccgtccagaggttgctgcctgtgctgtgccaagcgcacggactcaccccagagcaggtcgtggcaattgcgagccatgacgggggaaagcaggcactcgaaaccgtccagaggttgctgcctgtgctgtgccaagcgcacggcctcacgcctgagcaggtagtggctattgcatccaacaacgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcaggttcccaactcgtgaagagtgaacttgaggagaaaaagtcggagctgcggcacaaattgaaatacgtaccgcatgaatacatcgaacttatcgaaattgctaggaactcgactcaagacagaatccttgagatgaaggtaatggagttctttatgaaggtttatggataccgagggaagcatctcggtggatcacgaaaacccgacggagcaatctatacggtggggagcccgattgattacggagtgatcgtcgacacgaaagcctacagcggtgggtacaatcttcccatcgggcaggcagatgagatgcaacgttatgtcgaagaaaatcagaccaggaacaaacacatcaatccaaatgagtggtggaaagtgtatccttcatcagtgaccgagtttaagtttttgtttgtctctgggcatttcaaaggcaactataaggcccagctcacacggttgaatcacattacgaactgcaatggtgcggttttgtccgtagaggaactgctcattggtggagaaatgatcaaagcgggaactctgacactggaagaagtcagacgcaagtttaacaatggcgagatcaatttccgctcataaaaaatcagcctcgactgtgccttctagttgccagccatctgttgtttgcccctcccccgtgccttccttgaccctggaaggtgccactcccactgtcctttcctaataaaatgaggaaattgcatcacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagcacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcattaccaatgcttaatcagtgaggcacctatctcagcgatctgtctatttcgttcatccatagttgcctgactccccgtcgtgtagataactacgatacgggagggcttaccatctggccccagcgctgcgatgataccgcgagaaccacgctcaccggctccggatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccatcgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttg

SEQ ID NO: 4507 - DNA, 7947 bp, Artificial Sequence
  Nucleic Acid sequence of TALE_TF_TACGTACG
  misc_feature (2)..(805): pUC_ori
  misc_feature (1454)..(2054): CMV_Promoter
  misc_feature (2120)..(2839): TAL_N-Term
  misc_feature (2840)..(2941): Tandem_Repeats    "Repeat 1: NI"
  misc_feature (2942)..(3043): Tandem_Repeats   "Repeat 2: HD"
  misc_feature (3044)..(3145): Tandem_Repeats   "Repeat 3: NN"
  misc_feature (3146)..(3247): Tandem_Repeats   "Repeat 4: NG"
  misc_feature (3248)..(3349): Tandem_Repeats  "Repeat 5: NI"
  misc_feature (3350)..(3451): Tandem_Repeats  "Repeat 6: HD"
  misc_feature (3452)..(3511): Half_Repeat
  misc_feature (3512)..(4045): TAL_C-term
  misc_feature (4049)..(4051): NLS_(SPKKKRKVEA)
  misc_feature (4052)..(4222): VP64_AD
  misc_feature (4229)..(4291): 22A
  misc_feature (4292)..(5005): EGFP
  misc_feature (5641)..(6666): Hygromycin
  misc_feature (6794)..(6924): SV40_pA_Signal
  misc_feature (6979)..(7827): Ampicillin (complement strand)
ctcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaggcgagagtagggaactgccaggcatcaaactaagcagaaggcccctgacggatggcctttttgcgtttctacaaactctttctgtgttgtaaaacgacggccagtcttaagctcgggccccctgggcggttctgataacgagtaatcgttaatccgcaaataacgtaaaaacccgcttcggcgggtttttttatggggggagtttagggaaagagcatttgtcagaatatttaagggcgcctgtcactttgcttgatatatgagaattatttaaccttataaatgagaaaaaagcaacgcactttaaataagatacgttgctttttcgattgatgaacacctataattaaactattcatctattatttatgattttttgtatatacaatatttctagtttgttaaagagaattaagaaaataaatctcgaaaataataaagggaaaatcagtttttgatatcaaaattatacatgtcaacgataatacaaaatataatacaaactataagatgttatcagtatttattatcatttagaataaattttgtgtcgcccttaattgtgagcggataacaattacgagcttcatgcacagtggcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataggggcgtacggccaccatgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggctgaccccagagcaggtcgtggcaattgcgagcaacatcgggggaaagcaggcactcgaaaccgtccagaggttgctgcctgtgctgtgccaagcgcacggactaaccccagagcaggtcgtggcaattgcgagccatgacgggggaaagcaggcactcgaaaccgtccagaggttgctgcctgtgctgtgccaagcgcacggattgaccccagagcaggtcgtggcaattgcgagcaacaacgggggaaagcaggcactcgaaaccgtccagaggttgctgcctgtgctgtgccaagcgcacgggctgaccccagagcaggtcgtggcaattgcgagcaacggagggggaaagcaggcactcgaaaccgtccagaggttgctgcctgtgctgtgccaagcgcacggcctgacaccagagcaggtcgtggcaattgcgagcaacatcgggggaaagcaggcactcgaaaccgtccagaggttgctgcctgtgctgtgccaagcgcacggactcaccccagagcaggtcgtggcaattgcgagccatgacgggggaaagcaggcactcgaaaccgtccagaggttgctgcctgtgctgtgccaagcgcacggcctcacgcctgagcaggtagtggctattgcatccaataacgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaggcagtggagagggcagaggaagtctgctaacatgcggtgacgtcgaggagaatcctggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagaattcaaaatcagcctcgactgtgccttctagttgccagccatctgttgtttgcccctcccccgtgccttccttgaccctggaaggtgccactcccactgtcctttcctaataaaatgaggaaattgcatcacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagcacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcattaccaatgcttaatcagtgaggcacctatctcagcgatctgtctatttcgttcatccatagttgcctgactccccgtcgtgtagataactacgatacgggagggcttaccatctggccccagcgctgcgatgataccgcgagaaccacgctcaccggctccggatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccatcgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttg

SEQ ID NO: 4508 - DNA, 102 bp, Artificial Sequence
  Nucleic Acid sequence of TALE Monomer templates pNI
ctcaccccagagcaggtcgtggcaattgcgagcaacatcgggggaaagcaggcactcgaaaccgtccagaggttgctgcctgtgctgtgccaagcgcacgga

SEQ ID NO: 4509 - DNA, 102 bp, Artificial Sequence
  Nucleic Acid sequence of TALE Monomer templates pNG
ctcaccccagagcaggtcgtggcaattgcgagcaacggagggggaaagcaggcactcgaaaccgtccagaggttgctgcctgtgctgtgccaagcgcacgga

SEQ ID NO: 4510 - protein, 282 aa, homo sapiens
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMEMLA

SEQ ID NO: 4511 - protein, 262 aa, homo sapiens; identical to SEQ ID NO: 4470

SEQ ID NO: 4512 - protein, 461 aa, homo sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQREVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 4513 - protein, 704 aa, homo sapiens
MARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 4514 - protein, 115 aa, homo sapiens
MTMRHNWTPDLSPLWVLLLCAHVVTLLVRATPVSQTTTAATASVRSTKDPCPSQPPVFPAAKQCPALEVTWPEVEVPLSWAEGNLAPHPRSPALQPQQSTAAGLRLSTGPAAAQP

SEQ ID NO: 4515 - protein, 194 aa, homo sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWAGLRATLPPTQEALPSSHSSPQQQG

SEQ ID NO: 4516 - protein, 194 aa, homo sapiens; identical to SEQ ID NO: 4515

SEQ ID NO: 4517 - protein, 194 aa, homo sapiens; identical to SEQ ID NO: 4515

SEQ ID NO: 4518 - protein, 194 aa, homo sapiens; identical to SEQ ID NO: 4515

SEQ ID NO: 4519 - protein, 224 aa, homo sapiens
MPGGLLLGDVAPNFEANTTVGRIRFHDFLGDSWGILFSHPRDFTPVCTTELGRAAKLAPEFAKRNVKLIALSIDSVEDHLAWSKDINAYNCEEPTEKLPFPIIDDRNRELAILLGMLDPAEKDEKGMPVTARVVFVFGPDKKLKLSILYPATTGRNFDEILRVVISLQLTAEKRVATPVDWKDGDSVMVLPTIPEEEAKKLFPKGVFTKELPSGKKYLRYTPQP

SEQ ID NO: 4520 - protein, 105 aa, homo sapiens
MVKQIESKTAFQEALDAAGDKLVVVDFSATWCGPCKMIKPFFHSLSEKYSNVIFLEVDVDDCQDVASECEVKCMPTFQFFKKGQKVGEFSGANKEKLEATINELV

SEQ ID NO: 4521 - protein, 952 aa, homo sapiens
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPHVHSRAPSPLYSVEFSEEPFGVIVRRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPVEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 4522 - protein, 952 aa, homo sapiens; identical to SEQ ID NO: 4521

SEQ ID NO: 4523 - protein, 952 aa, homo sapiens; identical to SEQ ID NO: 4521

SEQ ID NO: 4524 - protein, 105 aa, homo sapiens
MFTCWWSYLRSTLAAVPGEASRVQQRKESKKPPAKLQPRALAGWLRPEDGGQAEGAEDELEVRFNAPFDVGIKLSGVQYQQHSQALGKFLQDILWEEAKEAPADK

SEQ ID NO: 4525 - protein, 104 aa, homo sapiens
MFTCWWSYLRSTLAAVPGEASRVQRKESKKPPAKLQPRALAGWLRPEDGGQAEGAEDELEVRFNAPFDVGIKLSGVQYQQHSQALGKFLQDILWEEAKEAPADK

SEQ ID NO: 4526 - protein, 116 aa, homo sapiens
MPSPGTVCSLLLLGMLWLDLAMAGSSFLSPEHQRVQRKESKKPPAKLQPRALAGWLRPEDGGQAEGAEDELEVRFNAPFDVGIKLSGVQYQQHSQALGKFLQDILWEEAKEAPADK

SEQ ID NO: 4527 - protein, 117 aa, homo sapiens
MPSPGTVCSLLLLGMLWLDLAMAGSSFLSPEHQRVQQRKESKKPPAKLQPRALAGWLRPEDGGQAEGAEDELEVRFNAPFDVGIKLSGVQYQQHSQALGKFLQDILWEEAKEAPADK

SEQ ID NO: 4528 - protein, 66 aa, homo sapiens
MFTCWWSYLRSTLAAVPGEASRVQFNAPFDVGIKLSGVQYQQHSQALGKFLQDILWEEAKEAPADK

SEQ ID NO: 4529 - protein, 204 aa, homo sapiens
MAGPATQSPMKLMALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 4530 - protein, 171 aa, homo sapiens
MAGPATQSPMKLMALQLLLWHSALWTVQEATPLGPASSLPQSFLLKCLEQVRKIQGDGAALQEKLVSEAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 4531 - protein, 207 aa, homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 4532 - protein, 875 aa, homo sapiens
MEKLHQCYWKSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 4533 - protein, 872 aa, homo sapiens
MATACKRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 4534 - protein, 852 aa, homo sapiens
MKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 4535 - protein, 745 aa, homo sapiens [sequence omitted]

SEQ ID NO: 4536 - protein, 133 aa, homo sapiens
MRKHVLAASFSMLSLLVIMGDTDSKTDSSFIMDSDPRRCMRHHYVDSISHPLYKCSSKMVLLARCEGHCSQASRSEPLVSFSTVLKQPFRSSCHCCRPQTSKLKALRLRCSGGMRLTATYRYILSCHCEECNS

SEQ ID NO: 4537 - protein, 528 aa, homo sapiens
MPTPDATTPQAKGFRRAVSELDAKQAEAIMVRGQGAPGPSLTGSPWPGTAAPAASYTPTPRSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 4538 - protein, 524 aa, homo sapiens
MPTPDATTPQAKGFRRAVSELDAKQAEAIMGAPGPSLTGSPWPGTAAPAASYTPTPRSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 4539 - protein, 497 aa, homo sapiens
MPTPDATTPQAKGFRRAVSELDAKQAEAIMSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 4540 - protein, 250 aa, homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATHMCMVMRGVQKMNSKTVTSTMLGVFREDPKTREEFLTLIRS

SEQ ID NO: 4541 - protein, 233 aa, homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATKSNKYNKGLSPLLSSCHLFVAILK

SEQ ID NO: 4542 - protein, 213 aa, homo sapiens
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATSAEP

SEQ ID NO: 4543 - protein, 250 aa, homo sapiens; identical to SEQ ID NO: 4540

SEQ ID NO: 4544 - protein, 205 aa, homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWVGALGDVSLG

SEQ ID NO: 4545 - protein, 239 aa, homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 4546 - protein, 434 aa, homo sapiens
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 4547 - protein, 193 aa, homo sapiens
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 4548 - protein, 536 aa, homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 4549 - protein, 487 aa, homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 4550 - protein, 536 aa, homo sapiens; identical to SEQ ID NO: 4548

SEQ ID NO: 4551 - protein, 449 aa, homo sapiens
MELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 4552 - protein, 536 aa, homo sapiens; identical to SEQ ID NO: 4548

SEQ ID NO: 4553 - protein, 346 aa, homo sapiens
MARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRIKNAIGVARKVLEHTTHTLLVGESATTFAQSMGFINEDLSTTASQALHSDWLARNCQPNYWRNVIPDPSKYCGPYKPPGILKQDIPIHKETEDDRGHDTIGMVVIHKTGHIAAGTSTNGIKFKIHGRVGDSPIPGAGAYADDTAGAAAATGNGDILMRFLPSYQAVEYMRRGEDPTIACQKVISRIQKHFPEFFGAVICANVTGSYGAACNKLSTFTQFSFMVYNSEKNQPTEEKVDCI

SEQ ID NO: 4554 - protein, 336 aa, homo sapiens
MARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRIKNAIGVARKVLEHTTHTLLVGESATTFAQSMGFINEDLSTTASQALHSDWLARNCQPNYWRNVIPDPSKYCGPYKPPGILKQDIPIHKETEDDRGHDTIGMVVIHKTGHIAAGTSTNGDSPIPGAGAYADDTAGAAAATGNGDILMRFLPSYQAVEYMRRGEDPTIACQKVISRIQKHFPEFFGAVICANVTGSYGAACNKLSTFTQFSFMVYNSEKNQPTEEKVDCI

SEQ ID NO: 4555 - protein, 1118 aa, homo sapiens
MSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 4556 - protein, 526 aa, homo sapiens
MYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMDQQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 4557 - protein, 524 aa, homo sapiens
MYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 4558 - protein, 527 aa, homo sapiens
MYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMQDQQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 4559 - protein, 346 aa, homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 4560 - protein, 158 aa, homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGSTFEERK

SEQ ID NO: 4561 - protein, 137 aa, homo sapiens
MITPTVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 4562 - protein, 153 aa, homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 4563 - protein, 200 aa, homo sapiens
MALWMRLLPLLALLALWGPDPAAAFVNQHLCGSHLVEALYLVCGERGFFYTPKTRREAEDLQASALSLSSSTSTWPEGLDATARAPPALVVTANIGQAGGSSSRQFRQRALGTSDSPVLFIHCPGAAGTAQGLEYRGRRVTTELVWEEVDSSPQPQGSESLPAQPPAQPAPQPEPQQAREPSPEVSCCGLWPRRPQRSQN

SEQ ID NO: 4564 - protein, 180 aa, homo sapiens
MGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 4565 - protein, 180 aa, homo sapiens; identical to SEQ ID NO: 4564

SEQ ID NO: 4566 - protein, 236 aa, homo sapiens
MVSPDPQIIVVAPETELASMQVQRTEDGVTIIQIFWVGRKGELLRRTPVSSAMQTPMGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 4567 - protein, 110 aa, homo sapiens
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 4568 - protein, 437 aa, homo sapiens
MIVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 4569 - protein, 316 aa, homo sapiens
MIVFVRFNSSHGFPVEVDSDTSIFQLKEVVAKRQGVPADQLRVIFAGKELRNDWTVQEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 4570 - protein, 465 aa, homo sapiens
MIVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQGPSCWDDVLIPNRMSGECQSPHCPGTSAEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 4571 - protein, 466 aa, homo sapiens
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 4572 - protein, 452 aa, homo sapiens
MFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISRRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 4573 - protein, 747 aa, homo sapiens
MADEAALALQPGGSPSAAGADREAASSPAGEPLRKRPRRDGPGLERSPGEPGGAAPEREVPAAARGCPGAAAAALWREAEAEAAAAGGEQEAQATAAAGEGDNGPGLQGPSREPPLADNLYDEDDDDEGEEEEEAAAAAIGYRDNLLFGDEIITNGFHSCESDEEDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISRRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 4574 - protein, 189 aa, homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 4575 - protein, 189 aa, homo sapiens; identical to SEQ ID NO: 4574

SEQ ID NO: 4576 - protein, 339 aa, homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 4577 - protein, 339 aa, homo sapiens; identical to SEQ ID NO: 4576

SEQ ID NO: 4578 - protein, 357 aa, homo sapiens
MGRQLAGCGDAGKKASFKMSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 4579 - protein, 339 aa, homo sapiens; identical to SEQ ID NO: 4576

SEQ ID NO: 4580 - protein, 180 aa, homo sapiens
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 4581 - protein, 167 aa, homo sapiens
MHWGTLCGFLWLWPYLFYVQAVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 4582 - protein, 455 aa, homo sapiens
MDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 4583 - protein, 298 aa, homo sapiens
MLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 4584 - protein, 200 aa, homo sapiens
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 4585 - protein, 570 aa, homo sapiens
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKPLQCEICGFTCRQKASLNWHMKKHDADSFYQFSCNICGKKFEKKDSVVAHKAKSHPEVLIAEALAANAGALITSTDILGTNPESLTQPSDGQGLPLLPEPLGNSTSGECLLLEAEGMSKSYCSGTERVSLMADGKIFVGSGSSGGTEGLVMNSDILGATTEVLIEDSDSAGP

SEQ ID NO: 4586 - protein, 429 aa, homo sapiens
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 4587 - protein, 426 aa, homo sapiens
MERPIKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 4588 - protein, 731 aa, homo sapiens
MDTSGHFHDSGVGDLDEDPKCPCPSSGDEQQQQQQQQQQQQPPPPAPPAAPQQPLGPSLQPQPPQLQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 4589 - protein, 509 aa, homo sapiens
MSMGAPRSLLLALAAGLAVARPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 4590 - protein, 423 aa, homo sapiens
MGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 4591 - protein, 509 aa, homo sapiens; identical to SEQ ID NO: 4589

SEQ ID NO: 4592 - protein, 509 aa, homo sapiens; identical to SEQ ID NO: 4589

SEQ ID NO: 4593 - protein, 509 aa, homo sapiens; identical to SEQ ID NO: 4589

SEQ ID NO: 4594 - protein, 354 aa, homo sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPSYCYRYRCAARSQNTPDSSASNLGFRCAADRLPTMD

SEQ ID NO: 4595 - protein, 349 aa, homo sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 4596 - protein, 374 aa, homo sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 4597 - protein, 196 aa, homo sapiens
MRLPLLVSAGVLLVALLPCPPCRALLSRGPVPGARQAPQHPQPLDFFQPPPQSEQPQQPQARPVLLRMGEEYFLRLGNLNKSPAAPLSPASSLLAGGSGSRPSPEQATANFFRVLLQQLLLPRRSLDSPAALAERGARNALGGHQEAPERERRSEEPPISLDLTFHLLREVLEMARAEQLAQQAHSNRKLMEIIGK

SEQ ID NO: 4598 - protein, 631 aa, homo sapiens
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 4599 - protein, 630 aa, homo sapiens
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 4600 - DNA, 1431 bp, homo sapiens
atggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtga

SEQ ID NO: 4601 - DNA, 2058 bp, homo sapiens
atggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaggagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtatacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcacctctggcatgctgaatgacaagtctctgtggacagacatccctgtgaattttccaaagaatggctgggctgcaattggaactcactcctttgaatttgcacagtttgacaactttcttgtggaagccacacgctaa

SEQ ID NO: 4602 - DNA, 942 bp, Artificial sequence
  ASPA codon optimized
atgacaagctgccacatcgcggaggaacacatccagaaggtcgcgatcttcggcggaacgcacggcaacgagctcacaggagtcttcctggtgaagcactggctcgagaacggagcggaaatccagcgcaccggactggaagtcaagccgttcatcactaaccctcgcgcggtgaagaagtgcacgcgctacatcgactgcgacctcaaccgcatcttcgacctcgagaacctgggcaagaagatgtctgaagacctgccttacgaagtgcgccgcgcgcaggagatcaaccacctcttcggaccgaaggactctgaagactcgtacgacatcatcttcgacctgcacaacacgacatcgaacatgggctgcacactcatcctggaagacagccgcaacaacttcctcatccagatgttccactacatcaagacatctctcgcgcccctgccttgctacgtctacctgatcgagcacccgagcctcaagtacgcgaccactcgctctatcgcgaagtaccctgtcggcatcgaagtgggacctcagcctcagggagtgctgagagcggacatcctcgaccagatgcgcaagatgatcaagcacgcgctggacttcatccaccacttcaacgagggaaaggagttcccgccgtgcgcgatcgaggtctacaagatcatcgaaaaggtggactaccctcgcgacgagaacggcgaaatcgcggcgatcatccaccccaacctgcaggaccaggactggaagcctctccaccctggcgaccccatgttcctcaccctggacggaaagactatccccctgggcggagactgcactgtctacccggtcttcgtgaacgaggcggcgtactacgagaagaaggaagcgttcgcgaagacgacaaagctcacgctgaacgcgaagtcgatccgctgctgcctccactga

SEQ ID NO: 4603 - DNA, 420 bp, Artificial sequence
  human GALC isoform 1 codon optimized
atggcggagtggctcctgagcgcgtcttggcagcgcagagccaaggccatgacagcggcggcaggatctgccggaagagccgcggtccccctcctgctctgcgcgctgctcgcgccgggcggagcgtacgtgctcgacgactctgacggactgggaagagagttcgacggaattggcgcggtgtctggcggcggcgcgacatcgcgcctgctcgtgaactaccccgaaccgtaccgctcgcagatcctggactacctcttcaagcctaacttcggagcgagcctgcacatcctcaaggtcgagatcggaggcgacggacagacgacagacggcactgagcccagccacatgcactacgcgctcgacgaaaactacttccgcggctacgagtggtggctgatgaaggaagcgaagaagcgc

SEQ ID NO: 4604 - DNA, 1431 bp, Artificial sequence
  human TFEB (Transcription factor EB) isoform 1 codon optimized
atggcgtctcgcatcggcctccgcatgcagctgatgagagagcaggcccagcaggaagagcagcgcgaacgcatgcagcagcaggcggtcatgcactacatgcaacaacagcaacaacagcagcagcagcagctcggcggaccgcctacccctgcgatcaacactcccgtgcacttccagtctcccccgcctgtgcctggagaggtcctcaaggtgcagtcgtacctggaaaaccctacgtcgtaccacctccagcagagccagcaccagaaggtgcgcgagtacctgtcggaaacatacggcaacaagttcgccgcccacatctctcctgcccagggatctcctaagcccccgcctgccgccagccctggagtgagagccggacacgtgctctcttctagcgcgggcaactctgcgcctaactcgcccatggcgatgctccacatcggatcgaaccctgagcgcgaactggacgacgtcatcgacaacatcatgcgcctcgacgacgtgctgggctacatcaaccccgagatgcagatgccgaacaccctccctctgtcttcgagccacctcaacgtctactcgtctgaccctcaggtgacagccagcctggtcggagtgactagctcttcttgccctgccgacctcacacagaagagagagctgacagacgcggaatctcgcgcgctcgcgaaggaacgccagaagaaggacaaccacaacctgatcgagcgccgccgcagattcaacatcaacgaccgcatcaaggaactcggcatgctgatcccgaaggcgaacgacctcgacgtccgctggaacaagggaaccatcctgaaggcgtctgtggactacatccgcagaatgcagaaggacctccagaagagccgcgagctggaaaaccactctcgccgcctcgagatgactaacaagcagctctggctgcgcatccaggagctggaaatgcaggccagagtgcacggcctgcctacaacatctccttctggaatgaacatggcggagctcgcgcagcaggtcgtgaagcaggaactgccgtctgaggaaggcccgggagaagccctcatgctgggagcggaggtgcctgacccggaacctctgcctgccctcccgccgcaggccccgctccctctgcccacgcagcctccctctcctttccaccacctcgacttcagccactctctgtcgttcggcggacgcgaggacgaaggcccgcctggatacccggaacctctcgcgccgggacacggatcgcccttccctagcctgtctaagaaggacctcgacctgatgctcctggacgactcgctgctcccgctggcctctgaccctctcctgtctacaatgtctcctgaagcctctaaggccagctctcgccgctctagcttcagcatggaggaaggcgacgtcctgtga

SEQ ID NO: 4605 - protein, 610 aa, Artificial sequence
  DHFR (version 2) amino acid sequence
MQKPVCLVVAMTPKRGIGINNGLPWPHLTTDFKHFSRVTKTTPEEASRLNGWLPRKFAKTGDSGLPSPSVGKRFNAVVMGRKTWESMPRKFRPLVDRLNIVVSSSLKEEDIAAEKPQAEGQQRVRVCASLPAALSLLEEEYKDSVDQIFVVGGAGLYEAALSLGVASHLYITRVAREFPCDVFFPAFPGDDILSNKSTAAQAAAPAESVFVPFCPELGREKDNEATYRPIFISKTFSDNGVPYDFVVLEKRRKTDDAATAEPSNAMSSLTSTRETTPVHGLQAPSSAAAIAPVLAWMDEEDRKKREQKELIRAVPHVHFRGHEEFQYLDLIADIINNGRTMDDRTGVGVISKFGCTMRYSLDQAFPLLTTKRVFWKGVLEELLWFIRGDTNANHLSEKGVKIWDKNVTREFLDSRNLPHREVGDIGPGYGFQWRHFGAAYKDMHTDYTGQGVDQLKNVIQMLRTNPTDRRMLMTAWNPAALDEMALPPCHLLCQFYVNDQKELSCIMYQRSCDVGLGVPFNIASYSLLTLMVAHVCNLKPKEFIHFMGNTHVYTNHVEALKEQLRREPRPFPIVNILNKERIKEIDDFTAEDFEVVGYVPHGRIQMEMAV

SEQ ID NO: 4606 - DNA, 1833 bp, Artificial sequence
  DHFR (version 2) nucleic acid sequence
atgcagaaaccggtgtgtctggtcgtcgcgatgacccccaagaggggcatcggcatcaacaacggcctcccgtggccccacttgaccacagatttcaaacacttttctcgtgtgacaaaaacgacgcccgaagaagccagtcgcctgaacgggtggcttcccaggaaatttgcaaagacgggcgactctggacttccctctccatcagtcggcaagagattcaacgccgttgtcatgggacggaaaacctgggaaagcatgcctcgaaagtttagacccctcgtggacagattgaacatcgtcgtttcctcttccctcaaagaagaagacattgcggcggagaagcctcaagctgaaggccagcagcgcgtccgagtctgtgcttcactcccagcagctctcagccttctggaggaagagtacaaggattctgtcgaccagatttttgtcgtgggaggagcgggactgtacgaggcagcgctgtctctgggcgttgcctctcacctgtacatcacgcgtgtagcccgcgagtttccgtgcgacgttttcttccctgcgttccccggagatgacattctttcaaacaaatcaactgctgcgcaggctgcagctcctgccgagtctgtgttcgttcccttttgtccggagctcggaagagagaaggacaatgaagcgacgtatcgacccatcttcatttccaagaccttctcagacaacggggtaccctacgactttgtggttctcgagaagagaaggaagactgacgacgcagccactgcggaaccgagcaacgcaatgagctccttgacatccacgagggagacaactcccgtgcacgggttgcaggctccttcttcggccgcagccattgccccggtgttggcgtggatggacgaagaagaccggaaaaaacgcgagcaaaaggaactgattcgggccgttccgcatgttcactttagaggccatgaagaattccagtaccttgatctcattgccgacattattaacaatggaaggacaatggatgaccgaacgggcgttggtgtcatctccaaattcggctgcactatgcgctactcgctggatcaggcctttccacttctcaccacaaagcgtgtgttctggaaaggggtcctcgaagagttgctgtggttcattcgcggcgacacgaacgcaaaccatctttctgagaagggcgtgaagatttgggacaagaatgtgacacgcgagttcctcgattcgcgcaatctcccccaccgagaggtcggagacatcggcccaggctacggcttccagtggagacacttcggcgcggcatacaaagacatgcacacagactacacagggcagggcgtcgaccagctgaagaatgtgatccagatgctgagaacgaatccaacagatcgtcgcatgctcatgactgcctggaatcctgcagcgctggacgaaatggcgctgccgccttgtcacttgttgtgccagttctacgtgaacgaccagaaggagctgtcgtgcatcatgtatcagcggtcgtgcgatgtcggcctcggcgtccccttcaacatcgcttcctattcgcttttgacgctcatggttgcacacgtctgcaacctaaaacctaaggagttcattcacttcatggggaacacgcatgtctacacgaaccatgtcgaggctttaaaagagcagctgcggagagaaccgagaccgttccccattgtgaacatcctcaacaaggaacgcatcaaggaaatcgacgatttcaccgccgaggattttgaggtcgtgggctacgtcccgcacggacgaatccagatggagatggctgtctag

SEQ ID NO: 4607 - protein, 236 aa, Artificial sequence
  mCherry mammalian codon optimized
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 4608 - DNA, 711 bp, Artificial sequence
  mCherry mammalian codon optimized
atggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 4609 - DNA, 786 bp, Artificial sequence
  3' UTR DHFR (version 2) nucleic acid sequence
aaggcgcgcccagcccacagaagctgcccgtctctcgttttcctctcttttcggagggatcagggagagtgcctcgggtcggagagagctgacgagggggtgccagagacccctgtgtcctttatcgaagaaaagggatgactcttcatgtggcatttcacacagtctcacctcgccttgttttctttttgtcaatcagaacgaaagcgagttgcgggtgacgcagatgtgcgtgtatccactcggaatgcgttatcgttctgtatgccgctagagtgctggactgttgctgtctgcccacgacagcagacaactttccttctatgcacttgcaggatggtgcagcgcaaacgacggagagaaaggagcaccctctcagtttccctacgatgtgctgtcagtttcgactcttcaccgcgaacgattggcgatacgtctctgttgacttgttaggctccgaccacgaagctcccttaactagataagccgcgacacctaagtgtacaccatttgcagatcgataatctgcgaccgctgaatccgtccagatcagtaaaaccgcaccacctaagtgtaaaccttgtttaggtcgataaaatgctaccaacccccacccacaatcgagccttgagcgtttctgcgcacgcgttggcctacgtgacttgctgatgcctgcctctggccattcatgccagtcagtgcgcataaaaatgtggacacagtcggttgacaagtgttctggcaggctacagtgacaccgcggtggagggggatccactagttcta

SEQ ID NO: 4610 - protein, 476 aa, homo sapiens
MASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 4611 - protein, 685 aa, homo sapiens; identical to SEQ ID NO: 4399

SEQ ID NO: 4612 - protein, 1699 aa, Toxoplasma gondii
MGVHHALDDAGEMPHSGGRRAVAPIYPLDLAGRLRPAMLVLADGTEFLGYSFGYPGSVGGEVVFNTGMVGYPESLTDPSYEGQILVLTYPLIGNYGVPSSEKDEHGLPKYFEGDRIYVRALVVADYDNAAVTAHFRAENSLSAWMNTHKVPAIAGVDTRALTKHLREVGCMLGKIVVLSEEEERRSGLSLSALAALPSATAAEQRGENDATVTPDKAEARLRVERRQAALTMWEEAIRNKAKNLPWEDPNKDNLVALVSRKEVRVYKSTVVDPNLRDVLILCVDCGMKYNIYRQLLHSKFEHCNIILKVVPWDFDFGNDEFDGLFISNGPGDPERCEKTVANIRRVMERKIPIFGICLGNQLLALAAGARTYKMKYGNRGMNQPVIDLRTSRCYITPQNHGFAVDESTLPRDFLPLFVNANDRSNEGIIHRTLPFFSAQFHPEASGGPTDTFYLFGDFIASIMKAQTLKQVHTTPFSFPQKFQKVLLLGSGGLSIGQAGEFDYSGSQAIKALKEQNIFVVVVNPNIATVQTSQHMADRVYFLPVTDEFVTKVIEKEMPDGILCTFGGQTALNCAVKLHEQGVLAKFGCKILGSPIEAIIATEDRKVFAAKLEEIGEKVAESAAATNTEEAVQAAKAIGYPVLIRAAFALGGLGSGFAEDEETVRRICKEAFSHSSQVFVDKSLKGWKEVEYEVVRDCKNNCITVCNMENLDPLGIHTGDSIVVAPSQTLSNEDYYRLRDTALKVIRHFGIVGECNIQYALDPNSEKYYIVEVNARLSRSSALASKATGYPLAYIAAKLALGSTLVELSNSVTKETTACFEPSLDYVVTKVPRWDLRKFESCDPLMGSAMKSVGEVMAIGRTFEESLQKALRMVDEKAGGFDESVCHFFSTDEDCAPSLPGSDFKTSSSGECMRGGCGRTDSGAERQAALLEAELRRPSPNRIWALALAFQLGWTVDALHEKTKIDKWFLSKLQNINDIKRQLTQLTLDDLTRADFFYIKKYGFSDRQIAQYLMNSPSAAALSQFDVRRRRLHLGVRPSVKQIDTLAAEFPAHTNYLYLTYQGIDDDVSPLAATPSVSAVFAGARAEKREEENAETCRDDEDESLLRRLSKSSSARLRTGEGDAPGKQCFVVLGCGCYRIGSSVEFDWSAVSCVRTLRSLGHHAIVVNCNPETVSTDYDVSDRLYFEDLSLETVLNIWDIEAPAGVIISVGGQTPNTLCSALEKQGVRIVGTSVAAIDCCEDRHKFSRLCDELNIDQPRWKEFTDLRTAKAFCQEVGYPVLVRPSYVLSGAAMRVVTDDEQLDAFLKIAAVVSGESPVVISKFVENAKEVEFDSVACRGEIVNFAISEHVENAGTHSGDATLILPGQKLYVETIRRVKKISQKLARALQVSGPFNIQFICKQNDVKVIECNLRASRTFPFISKAFNVNLIDLATKVMIGAPVTPLPIHLMDLSFVCVKVPVFSFARLRGCDPVLGVEMRSTGEVACFGASKHEAFLKALISAGVPLPLEKRTILISAGPLWSKMELEPYFKILLDLGFTIYATEGTYRFLMNSVVRGQGTHLPGNASPASDSGLRTPTTAESDADACIRAKYASRIIRVRKPIVGSNESHNGGHQSPHALSLIESGKVEMVINVPDSMNHRAATNGYLMRRTATDCGVPLLTNVKVASMFVEALNKKEAKEAQGRSFWDIRSWDEYWPQK

SEQ ID NO: 4613 - DNA, 5100 bp, Toxoplasma gondii
atgggggtccaccatgcgctcgacgatgcgggggagatgcctcacagtggagggcggagagctgttgctcccatttaccctctcgatctggcaggacgtctgagacctgcaatgctggtgttagccgatgggactgagtttctcggatactccttcggctacccaggcagtgtgggaggcgaggtcgttttcaacactggtatggtcggctaccccgagtctctgacggatccttcgtacgaggggcagatcctcgttctcacataccctctcatcggcaactatggcgttccctcttcggaaaaagatgagcatggcctgccgaaatactttgagggcgaccgcatttacgttcgcgctctcgttgtggcggactacgacaacgcagccgtgacggcacactttcgtgcagagaacagcctcagtgcttggatgaacactcacaaagtcccggcgattgcaggagtcgacacgcgagcgttgaccaagcacctgcgcgaggtcggctgcatgctgggcaagatcgtcgtcctgagcgaagaagaagagcgtcgatccggcttgtcgctctcggctctcgccgcgcttccctcagcgactgcagcagagcaacgaggagagaacgacgcgacggtgacgcccgacaaagcagaggcccgcctaagagtggagaggcgacaagcagcgctcacgatgtgggaggaggcgatccgcaacaaggcgaagaacctgccatgggaagaccccaacaaagacaacctcgtcgccctcgtttcgcgaaaagaagtgcgcgtgtacaaatctactgtcgtggatccgaatctccgcgacgtcctcatcctctgcgtggactgcgggatgaaatacaacatctaccgccagcttctccatagcaaattcgagcactgcaacatcattctcaaggtggtgccgtgggatttcgactttggcaacgacgaatttgacgggctcttcatcagcaacggtccaggcgaccctgagagatgcgaaaaaacagttgctaacattcgacgcgtcatggagcgaaagatccccatcttcggcatctgcctaggaaaccaacttcttgccctggctgccggcgcgagaacgtacaaaatgaaatacggaaacagaggaatgaatcagccggtgatcgacttgcgaacgtcgagatgctacatcacaccccagaaccatggctttgccgtcgacgagagcacgctgcctcgagatttcctgccgctctttgtaaatgcaaacgaccgttcgaacgaaggcatcatccatcgcacgctgccttttttctctgcacagttccacccagaggcgtcaggtggtccgacagacacgttttacttatttggcgacttcatcgcctcgattatgaaggcgcagacgctgaagcaggtccacacgactccgttctcctttccgcagaagttccagaaagttctgcttctcgggagcggaggcctgagcatcggccaagccggggagttcgactacagcggctctcaggcgataaaggcgctgaaagagcagaacatctttgtcgtcgtggtgaaccctaacatcgccacggtgcagaccagccagcacatggccgaccgggtgtacttcctgcccgtcacggatgagttcgtgacgaaagtcatcgaaaaggaaatgcccgacggcattctctgcacattcggaggccagacggccctcaactgcgctgtgaaactccacgaacaaggcgtcctggcaaaattcggctgcaaaatcctcggcagtccaatcgaagcgatcattgcgactgaggatcgaaaggtgtttgcggcgaagctggaagaaatcggagaaaaagtggcggagagcgcggccgcgacaaacacggaagaagctgtgcaagcggcgaaggccattggctaccccgtcctcattcgcgccgccttcgcactcggtgggctcggatctgggttcgccgaggacgaggagaccgtccgacgcatttgcaaggaagccttctcccattcttctcaggttttcgtggacaaaagcctgaagggctggaaggaggtggagtacgaagtcgttcgcgactgcaagaacaactgcatcaccgtctgcaacatggagaacttggatcccctcggcatccacacgggagattcgattgtcgttgctccttcgcagacgctgtctaacgaggactactaccgcctgagagataccgcgctgaaggtgattcgtcacttcggcatcgtcggcgaatgcaacatccaatacgcgctcgaccctaactcggagaaatactacatcgtcgaagtcaacgcgcgtctctctcggagcagcgccctcgcgtccaaagccactggctaccctttggcctacattgcggcgaagctcgctctcggctcgactttggtggagctcagtaactccgtgacaaaagagacaaccgcctgcttcgagccttcgctggattacgtcgtcaccaaggtgccgaggtgggatctgcgaaaattcgagtcgtgcgaccccctgatgggcagcgcgatgaagagtgtcggcgaggtcatggccattggacgcaccttcgaggagtctctgcaaaaggcgctcagaatggtggacgagaaggccggcggcttcgacgagtcggtctgtcactttttttccacggacgaggactgcgcgccttcgctgcccgggtcagacttcaagacgtcctcctctggagaatgcatgcgtggcggctgcggacgcacagactccggcgccgagcggcaggctgcgctgctggaggcggaacttcgccgtccgtcaccgaatcgaatctgggcgctggcgctcgccttccagctcgggtggacggtcgacgcgctccacgagaaaacgaaaatcgacaaatggtttttaagcaaacttcaaaacatcaacgacatcaagcgacagctcacccagctcaccctcgatgacctcacgcgcgcagatttcttctacatcaagaaatacggattcagcgaccgtcagattgcgcagtacttgatgaattcaccgagcgcggctgcgctgtcgcagttcgacgtgcgtcgtcggcgactgcacctgggcgtcagaccgtcggtgaagcaaatcgacactctcgcggccgagtttcctgctcacacgaattacctttacttgacctaccaaggaatcgacgacgacgtctcgcctctcgccgccacgccgtccgtctcggcggtcttcgctggcgcgcgagccgagaagagagaagaagaaaacgcagagacatgcagagacgacgaggacgaaagtctcctccgccgcctgagcaaaagctccagcgcgcggcttagaaccggcgaaggcgacgcacccggaaaacaatgttttgtggttctaggctgcggctgctaccgcataggatccagcgtcgagttcgattggtccgctgtttcgtgtgtccgtacacttcgctctcttggccaccacgcgattgtggtaaactgcaatcccgagactgtgtcgacggactacgacgtgagcgatcggctgtatttcgaagacttgagcttggaaacagtcttgaacatctgggacattgaagccccggcgggagtgattatttccgtgggcggccagacaccaaacacgctgtgctctgcactggagaagcagggcgtgaggatcgtcgggacgagtgtggcggcgatcgactgctgcgaggacagacacaagttctcccggctctgcgacgagctgaacatcgaccagccgaggtggaaggagttcaccgaccttcgcacagcgaaggccttctgccaagaggtcggctacccagtcctcgtgcgtccttcctacgttttgagtggtgctgccatgcgagtggtgaccgacgacgagcagctcgacgccttcctcaaaatcgcagctgtcgtcagtggcgaatctcccgtggtcatctccaagttcgtcgagaacgccaaggaagtggaatttgacagcgtcgcttgccggggggaaatcgtaaactttgcaataagcgagcatgtggagaacgcgggtactcactctggagacgcgactttgattctccctggacagaagctttacgtggaaacgattcgtcgcgtgaagaagatctcgcagaaactcgcgcgcgcactccaagtctcaggtccgttcaacatccagttcatctgcaaacagaacgacgtgaaagtcattgagtgcaacttgcgagcgtcgcgtactttccccttcatcagcaaggccttcaatgtaaacctcatcgacctcgcgacaaaggtgatgattggcgcaccggtcactccgttgccgattcacttgatggacctttccttcgtctgcgtgaaagttccagttttctctttcgcgcgtcttcgcggctgcgacccggtccttggcgtggaaatgcggtcgactggagaagttgcgtgcttcggagccagcaaacatgaggctttcctcaaggctctcatctcggctggtgtgccgctgcctcttgagaagcgaacgattctcatcagcgcaggccctctgtggtcgaagatggaactcgagccgtacttcaaaatccttttggacctgggcttcacaatctacgcaacggaaggtacctacagattcctcatgaacagcgtcgttcgcgggcaggggacccacctgcctgggaacgcgtcgccggcgtccgacagcggccttcggactcctacgacagccgagtccgacgcagatgcgtgcattcgcgcgaaatacgcatcgcgcattattcgcgtgagaaagccgattgtcggatcgaatgagtcgcacaacggaggtcaccagtcacctcacgctctctccctcattgaaagtgggaaggtcgaaatggtcatcaatgtgcctgacagcatgaaccaccgagcggccacaaacggctacctgatgcgtcgcactgcgaccgactgcggagttcccctcctgacaaacgtcaaagtggcaagcatgttcgtcgaggccctcaacaagaaagaagcgaaagaagctcagggtcgctccttctgggacattcgcagctgggatgaatactggcctcaaaaataa

SEQ ID NO: 4614 - DNA, 24042 bp, Toxoplasma gondii
atgggggtccaccatgcgctcgacgatgcgggggagatgcctcacagtggagggcggagagctgttgctcccatttaccctctcgatctggcaggtcagtccgccgtttcgttcagacttccttctcgtctgggttctttgtttcacacgcctggccgcgtctcctctccgcttcttggtgtgcagcctcggtttctcccctttgatcagctgtctcggttgcgcttccgccccgtgcgtcgccttccgtgtttgcttccaattttctcctggcttgctcgtgtgttcgcgcccctccggggagaccggcctgtctgctgccgacagagaggcagctgtgaagggcgtgatcatcaactgtctcgacggagagacacgacgtctgtgatgcaagcaaatgagcgcgtgtatgcacaggtacccgcgcatactgaaatattttcgtatctgcagatccacaggcgcatgcatgcgcccaactgtacccacgcgtgtttctacatagttgtggagaggcacatgcgtctgcatgtgtgcacgttgtctattcttgcgaacgataaacctggtggcgatccgtgtgttattttcaagaagtgatttcgacgcaggccatctcgctcgtcgctcgtttcctgtgtttgtcggctgctcgcaggacgtctgagacctgcaatgctggtgttagccgatgggactgagtttctcggatactccttcggctacccaggcagtgtgggaggcgaggtcgttttcaacactggtacgtttttctcgaatttgtccagaaacgctgacgtttggcgtctctcctctccagaaagggtgcattcggtctatccgctgtgtgctgcagcgattggtcctcctcttacaagcgcgtacaccaccctatgcagcctcatgcaccgccatctgtcaacgcgtgtggggaccgccaccacacgcccatgtatctaccttcgataaacatatttatgcatatatatatatatatagcatatatatatatatatatagcatatatatatatatatatatatgcatgtagatactcaaaatgcatgcatattggtacgtctgttcacctgtatttttctgcgtgataattagatacccctgggttgcgtcaccatgagctgtgtatcgttctgggtgcatgcgttgttgcgggagtgttcgtgcgtcgggaaaggtagtggccgacttcttgtctttggcgtggttaggtatggtcggctaccccgagtctctgacggatccttcgtacgaggggcagatcctcgttctcacataccctctcatcggcaactatggcgttccctcttcggaaaaagtgagagcagacagcaagaaaacgaagagactagcagaaccccgtacttcgtggctgatccacatcagtgagagtcgaggagggagagtcggatttctcttgcgacgcaacgtcacaggaaagcaagtctggcaggggtctccgctttctcacatgccgaatgcgcacacaaatcattcatacgtcactacaaaactgagtcctacgtgagaagagcaacgtcacctctccgtgagacatatacgtgtttctatatacatatatacatattatgtatatatttatattcaaatatatatatatatatatatatcaatgtgcatatctaagtttatatatgaacgttcatctgtctttcgggagagtatttccctaaatggcagatgctaagacgcctgtacacctgcgtgcaaaggtgtttacgcgggtgtctacacgtgagcgaagtgattgctacacacatgtatatatatatatatatatgtatgtcgctttacagtgtttgtttttctgtacatctaaagtcgtctaggcatcgatatgcgatgtgcatttcagcgtatttcgtgtgtttcatttccactcttcaggatgagcatggcctgccgaaatactttgagggcgaccgcatttacgttcgcgctctcgttgtggcggactacgacaacgcagccgtgacggcacactttcgtgcagagaacagcctcagtgcttggatgaacactcacaaagtcccggcgattgcaggtgcgaaaacatcgaggccgaagtgtctgtagtgtcagatgcgcctctggacacgacatcctctttcgatgcttgtctttgattttcacttaattttctcttcgcaagtctgcgaaggaacgcctgtctgtacatctcgatgcccaggtggctttctcggccatttggaggaactgtcttggatccgcgtagtaggcatgtatgagggagcagcttctctttcttctgaattgtgttccacttgtaagtcggttcgaccacgagcagtcaagaggctcttaccgtgccaccgagtcaacgtcgcccatcacagaccggcttttgaatgcctttttcttcaggctccattaatgcacgtctcactgaatccgtgctcgtcaatttggacagctagatctgtgtagtccctagagactaacttttggagggagactaacaatacagctaggttgctctacctcggctatgtttaacgcatagttcacggatcactgttgccactggtccttacagagagagcacacgactgctcacgtgcttgtcatggagacacatctcgatcgtgtatgtttcacttcagttctgcagagccgttcagtgtatgtctgccatgacggggaggggtatctcaagggtgtattttgaactgtatttccacggtgtacggggcttgaagtactggcgcatctatgtctggaggacgggacgtggtttagttcgtgtctcagtgctcaacagcgtccggatctctggcatgctgttgccatcctgttagttgctggccttcgcggctactctttctcctttaggtgcacctccagtgtctccagttcagctggtgttcccttgccgactgttgctgctctgtcagggctttgtaggtccccgcctcactctcgtttccgcttctctgttttctgcgtccgtgtgtgtctcacctcttcctcttcgtttccatctcttttcttgtctcgcctttccacggctctcgtttgctcttgaaacgctgtcggttgtcgtcgttccgcctcgttctctattcggctctatcttcgtcgttcgtcttttgcttcttttcgacttcccgactcctgcctgtttccggctgtatcgttttctttttcaaggagtcgacacgcgagcgttgaccaagcacctgcgcgaggtcggctgcatgctgggcaagatcgtcgtcctgagcgaagaagaagagcgtcgatccggcttgtcgctctcggctctcgccgcgcttccctcagcgactgcagcagagcaacgaggagagaacgacgcgacggtgacgcccgacaaagcagaggcccgcctaagagtggagaggcgacaagcagcgctcacgatgtgggaggaggcgatccgcaacaaggcgaagaacctgccatgggaagaccccaacaaagacaacctcgtcgccctcgtttcgcgaaaagaagtgcgcgtgtacaaatctactgtcgtggatccggtgagtgacagagagcccagggaaagacgtttcacgtgcgaaagcgaaacgcagtttccacagtccttgtttagatttagcgtgggacatgcacaagttgggattctgcggaatgccgctatctggggaggggagtatagacgccgagttcaactcctggcttcaatctcccctcaatcgaggcgtagcgcaacgcgctcgctttgcactggtttcgccgccccggaggtccgtgctgagctgtacgtacatccggggtgtgtatgcccgttgcgatcgcgtttgagtgttttcggggtctgactgtgcgtgtccggggcctcccgggcggcgcctgtcgaatgtgcggctcggctttgcccgccttctttctccaaagtgtgtctggactgcctttctgtgttctgtcggaatctcaagtctgggctgtcggtttcgttgcctgaatctgcagaatctccgcgacgtcctcatcctctgcgtggactgcgggatgaaatacaacatctaccgccagcttctccatagcaaattcgagcactgcaacatcattctcaaggtacagctgtcgctgctctgactgcattgactttgaaactctcattcctgatctgttagctctcccggcagttcgcttgtattttctgtttcctgtggcgcccacccgtcaattcccctttctgcggcgccgagcgctcttcagctggtactgggaaatggagatgtgtgtccagcagtatcaagacatacagaagtatactgatgtgtacacgtgaatctccattctgtttatgcatgcatgtctctctctctctctctatatatatatatatatatttgtacatgtatttatgtgtgtgcgtgcgtttgaatataagtacgtattatctacaagtttgcatgtttccgtacgaatgtccgcaggcgtgtgtgtctggttacatgccgctgaatctcactattcaattaaacagttgagtgtggagaggtaagcgagactgtgactgcgcaggtgtgaaaccgttcaggagcgcatgcgctgtgcgtgtctctcaggtggtgccgtgggatttcgactttggcaacgacgaatttgacgggctcttcatcagcaacggtccaggcgaccctgagagatgcgaaaaaacagttgctaacattcggtgtgtgctgcagagaaaagccgattcgttcgccagagtcaggaacagcacagtggcgcatttccatttccgtcttcgctgtagacacgcaaaaccatcgcgatttgcagattggttgagcttgctctctgagtcgcgggaaactgttccttccgttccatggcgacccaggcacagagaagcgtgcatgcaaaaaacaacgtggagtctctccgttttgtctctgctaacttagtataacttagacccggcaaacagcgacatgcacgagttaaacgcgtagtccatctcttacatgaaatggactctttagaaagcgcaagacggtgcacgctacaccagcctcgttcgtaggcttgcgtattgagttcacgcgattgaacaccgaattgtcgaggcgggaagttcgcgtctaccacatattcatctgagttccatctcgggttgctccggttcgggccaaggtgactggaatgcccggtggctgccgggtactatgtgcttccccgcggatctcccatgttctcttgtgtgggcagactgcgcagcactgctggtggctgcgtaggttcatgcccttacaatgtaaatcccttttctaccgttcgttcttcctcccgttttcagacgcgtcatggagcgaaagatccccatcttcggcatctgcctaggaaaccaacttcttgccctggctgccggcgcgagaacgtacaaaatgaaatacggaaacagaggtaagcgttgtcgttcgtcggtcacactgattgtacgccgtttcaggtgtacgtacacctctttcaccggcagcgaggcgccggtccagggagcgtcccgcgacgtgggtggcaggccagtgactagcgacggcgaggcgaagagggaaaatagcatctccggactctcatttctgttttgccgttgcaggaatgaatcagccggtgatcgacttgcgaacgtcgagatgctacatcacaccccagaaccatggctttgccgtcgacgagagtaagcggcgacaacattccatctgcgaaatctaggtgccatgacctccatatgccgttatcgtagacataatgttgatatgtagatgcatatggatacgtcgagagaggtacagattcacttttgtagatgtagacggctataaatcaaagtggttcatgcatctgctgttggttgtattttgacagcattgtgaaagggagtggtgttcgatagaacgcaaatgtgacgcaattgtatccgtaagaccctgagtttcattataagtaggtattgcctctgtacaaatgatccgcgagccagaactgtataactcaaaccgaataaacagagtgtctgtcgctgtgaatacgaatggtaacagtaatccatatattgcgcctagaacgtaaccgatgtggaataacgtaaaaatgcgtgtttgagccctccacgtcagcggtctgtcgattgtgaattagcgaagccgacccgtcgatgaagttcaacagtcagccagatattcagtctctagaacctccacaaaggatgatgtcctccaggtagcgaagataccaactgtggtgttggagaatggcgtttcaaagccggtagcgttgcagacactcttgtgtcctcgtgggagtccgtgttcgaggcgggcagttgctacagcaagtagatgcgtagaacgaagcgagacctccacgcggggatttaccttttgacatcagttctggaagactgcagatcctttgcacagatgcaatatctgcttacggtgtggcgcttacaatacatggtcgagctatgctcctgtcggtctcagtgcggccttcgtcagatgacagatgtggacacctgcctatatgaccctgtgttgaacctctcgccgtttctgcaggcacgctgcctcgagatttcctgccgctctttgtaaatgcaaacgaccgttcgaacgaaggcatcatccatcgcacgctgccttttttctctgcacagttccacccagaggcgtcaggtaaggcggcgatacttcttcgactgaaataccgacgttgcagatcagcgacatctctttccgttggcgtcgtttcaatgatcagtgcttgaaggcatcttggcagcgtttcgtcggaccaatacggcggaactggagctcgacggtacaaggaatctgtgactgccgatgctcttctcgatgatgcaggggcgacagttcctttcatgagggaaacatgtgcttgtgtcatcagttcagttcctcataactggaggcatctgttgggtcttaaataaagccgcccgctaagaaggatgctgccttgcgacgcaactcgtgtgtcaccaactgcatcgcgatgggagagtttttcctctgagacaaaacgaggatggacctccgaagttcgtgtacgcagtctgcgagtcagtggggtgccgacgcacgagacgaagacgagccactcagagattattgtttctcacttttctgcctcggcgaagaagcagcgcatacccatcggtgcccctccgctgggcgtctcgtgcgttccctgtcgctggcgcggcttcgtcaacacagtgcaccgattttttcttctgctcgtttgtgacaacctagagagctccagtgagatcgaggagtggcgcgagatgtgagtttcacgcggtggaggccagatgatgtttcgtcaagagctgcgccgcagtctaccacgcagcgcagaccccgtggggtgtgtccttcgcgcgattctttcctggagtctgtggggtgtttatacactcggcgtccctctgtctgtgccttctggctcaggtggtccgacagacacgttttacttatttggcgacttcatcgcctcgattatgaaggcgcagacgctgaagcaggtccacacgactccgttctcctttccgcagaagttccagaaagttctgcttctcggtaaggcggtgttcctcccgcatcttgagggaaggcgagttcttttaaagtgcagaaagccctttgcgggggtcatcagagaaggaacgccatcggctgcatccttcttggtttctcgcaaatgcgtctgtggctggccgtcgcgtggtaccttctgaacgcccgtgtggaggtttcccgacgctgtcatctctgccaaggtgtcgtcgtggacgttcaagagtgcgagagcggccctgccgactgtcgcagagagcgcggctcatgtcatgtctcccttgtgcattctccctgagcttttcgcgggctctctttcgacctctgtctccgccgggatcatctgtttaggaggaccgtgtcgtggtgactgtgccggaggctctgctcgctcaagtgaggaggtcggggtaaggcgggaagtcggctgtgtgtgcgtggtttatttgcttcgtagggagcggaggcctgagcatcggccaagccggggagttcgactacagcggctctcaggcgataaaggcgctgaaagagcagaacatctttgtcgtcgtggtgaaccctaacatcgccacggtgcagaccagccagcacatggccgaccgggtgcgttgaccgcgcagacggattgcgcagagtggcgtcgagggagcgcgaacgaaaaaggaggacgcagacgccagagaagacacagagaatcagagagacagcgagagacagcgagagacagacagcgagacagaagatcaatcgggaggcaaggaggagagcgaggtagagagaaaccgcgagaaacacagagaggagcagagagctaacaagacagaaacaaagcgtggtgcaggaagacgcagatgagagggagagacggagcccagagcagagacagaaagacagagcaaagagagacacagacagaacagagagagagagataagggtggaggtgaaggaataaaggcggggcttgagcgaacggtgaagcattaggccgtggaaggtgacgaaagtgcgatggaggcaggatggtctttgtgaggccttctttgtcggaagaagagagtggacaccacgtatttccactgctgcgttgcgtaacgcgtttatgagagagtactgcggttccccagagactggcggaaaccaaggagtcggcaggctttctcgggtctctctcccctctgcgttgtgagtttcctaacgtctgtcgacttcgggaagtccgaaactctccggagaagacacacgcaactccaaactgcgagtggagtcgagccgatccagtcgagtagtagcttgcatgaaatgtgtcgagccgggtgcatgcaattcattttttcaggtgtacttcctgcccgtcacggatgagttcgtgacgaaagtcatcgaaaaggaaatgcccgacggcattctctgcacattcggaggccaggtgcgtttgcgtgtgtgcaacggctttttcctcgatgaacgtaactaaatgcgcgaagatataacgaggcctaggcactcgcaaatggacaatccatccatatgcatatatattcatatatatgcatgtttaatatatatatatatatatatatatatataataatatgcgtatggggctggccattgaggagatatgtatgcagctgttcagaggagtagcgtaggcgaacacgtttgcatgcatagagttctggacgaagcacgtgatcgtgcggatatatgtaaatgaggttgtgggtgtatgtggggacagcgatatctggacagggtacggctttttttttcactttatggcatgttcagacggccctcaactgcgctgtgaaactccacgaacaaggcgtcctggcaaaattcggctgcaaaatcctcggcagtccaatcgaagtaagaatgtattcatatatatacatccatatatatatatatatatatatatattcgtaactgcataaatgcacatattcatagtgatacatatatatatgcacatagacatatgcaagtacatccgcgcacacatatgtccatatatgtgtgtatatccatatataaatatatatccatatatatatatatatatatatgtagagaaatgtgtgtgtgtatcagtgcacgttacgatgcacaaatttgtatactggtgtgtatttaggtatccgcgcatttcgagtttcgtgggaagcacgcggtgtcttgtttgtcttttttaggcgatcattgcgactgaggatcgaaaggtgtttgcggcgaagctggaagaaatcggagaaaaagtggcggagagcgcggccgcgacaaacacggaagaagctgtgcaagcggcgaaggccattggctaccccgtcctcattcgcgccgccttcgcactcggtcagccaaagaagagaccggggagtgaagacgagcgaagaaaaggggcgcaaggtcgacgagagcaatgagaggagacccagaaaaggcgcacacagaacggatgcagacggaaacagacgaggcgacaaaagaggcagtcgatgacagagaagaatgcgagggagacggaagcaccgaagacgaagggaagagaactggccagaaacgaaggatacggatttcacgttcaagtgatgtcaacttgcgtgtggactatcgcaggtgggctcggatctgggttcgccgaggacgaggagaccgtccgacgcatttgcaaggaagccttctcccattcttctcaggtccggtcaacttctcgtagtgcatgcgtatacgcacatcagagtaaaatttgcatatatatatatatatatatatatataagtatatgtatgcacacatatatgtttcagttcttatctgcgggtgtacttgtgcatgtccgcaccggcgtcgtgtgggcagatgtgaacgtctggagagagaggtcgcccgttctgaatgcgcgtgcatgcgtttctgacaggcgtgtctgcatggctgcggaagccgaatgaaaccccacacttccgaaggaatttcgcgtttcagccggttcgtttgcaggccgagtgtcgtcggggaggcttcctcgttgtgttggtgtgtgccggtccagtggttctcgcgcgaagccccgagtgcgtcccctataagactgaaaagcgccaagtcgagctggcggaactctgagaatttacgttttttcaggttttcgtggacaaaagcctgaagggctggaaggaggtggagtacgaagtcgttcgcgactgcaagaacaactgcatcaccgtctgcaacatggagaacttggatcccctcggtgcgtctcgtctgtgtgcatttgccgtgtttgctcttcaactgtggcttctcagctctgtcgaggggtgcgctgcggaggctcgctgtacaccacgaattgtttctggcctctctgttaacgagcgttctgaaacgaatccccacacaagtgcatgctccctctcgtcctctcgctgcttgactctgtcgctgcgggggaatccctcgtaccgtgctctcgctgtgacgacctctgagtggacgcgtctctctcggacttctctttgtctctcgccagacgcagtgattccaagtctctctctttttgtgcagcgctgtctctgacgaacgctgtctatcggcgtatctctccttctccgcttctccagagcttggcacttctctgtataaagatttacatatatatatatatatatatatatatatatatatatatatatatttgaatgtttttgtatatgcactccatctggataattcagtcgtcgaactctattgtcacagcgttttggtcacttaaaccggcgtccttcgtcgatggtttgcgcatgcgctttttgcgtccatgtctgtacacccgcgtgtggattttttcccctcaggcatccacacgggagattcgattgtcgttgctccttcgcaggtgagctgtcttcgcttgtgtttttctgtttttcatctctctttatacatttctcggtccgatatttctgctctctcatggcctctcttttgccattttcctcgttgttttctcttatccctcgttcttcctcttgttatgtcttcttcttatcctttgttatcttttgtccgcgttggtctattgttgtctccgcttcaaatcccttcgtctcccacacaagcgcgcgttttcttctttgctctctctcttcagacgctgtctaacgaggactactaccgcctgagagataccgcgctgaaggtgattcgtcacttcggcatcgtcggcgaatgcaacatccaatacgcgctcgaccctaactcggagaaatactacatcgtcgaagtaggtgacaagagagtgcaaacgaaaaaccacgggaggcgaagggaacgcggtcttacagaggatgatgccgcgaggaaaggtggacgaacaccctgaaacaggagagaggaaagcgagaaccggacaggctcacaccaaagtcagacagaggccacagagcgagaaggacagggaggtgcagaagcggagagaccggccagaaaagagagagacaggggcggagataagtgctacagaaagtcgagagaagctttctcgatcctagctcaggttcgatgtcacctgcctcgcgctgtgcggcatggccacacgcatgctgaaagtcaacgagaaggtcgccaagcagttctacaaatcaagcactgtccagacagctgctgacgggcattccgtttttccttttgtgggcgtttgtgtcgctgtctccgacgttcggacgtcccgcgactacagcgtctctgactttccagacgcctcgctttctcatctcttctcccgcttcgctgtcttgtgggccttttcctcaccgcaggtcaacgcgcgtctctctcggagcagcgccctcgcgtccaaagccactggctaccctttggcctacattgcggcgaagctcgctctcggtaacgtttgtctcccttctgtttcgtcgaaacttctgagtggcttttccgaactgttcgtcccagagtcgatccgcatggcccgctcaaagcccagcatcccctttcattgctgctctccttgatgcttcaagcgtgtctgcacggccttccttctgttcttaaattcgcggcggtgatgtgcgtttccgtctaatcttctttgtctcgtcggctgagtgaggtggtgcttcggtcggttttcatcctcgagaactggcagtgtgtgtcgcatgttttctctctccatgtaggctcgactttggtggagctcagtaactccgtgacaaaagagacaaccgcctgcttcgagccttcgctggattacgtcgtcaccaaggtgccgaggtgcgaggacacaacgcacacagatagaagttccatagggactcccaggacaccagtggtttcttccctcttctctttgtggcccgactgctccctcgttctctctttcctgcctctcttcatctcttcctctgtttctctcttcgttgttcctgtccttcgccgtctcttccgctgttcactgttggggtccgttccagttcggccgtcgcttgcgtgtcaacgtgtgtatggttctctctcctcaacgtcaccacgtcgccagcgtccttgcccaaaattgtttctgccttctgcaggagctcaacgccttctgttagatgcctctctgacgcatgctttgcatctctgcactcgatagagacttgccgttttgaggaagaagtttccagagcgtctgagagagtgtcctcgcgcgtctctcgacgtccagcgaggctcgcgcctcctggcggtgaacagattcgtgttgaatatgtctttctgctctcaggtgggatctgcgaaaattcgagtcgtgcgaccccctgatgggcagcgcgatgaagagtgtcggcgaggtcatggccattggacgcaccttcgaggagtctctgcaaaaggcgctcaggtaaaccacaaagttccaatcatcggcatccgtcgacaaacagttgtcccagttgaagttattgtagccacatctctcttctccgcatttcctctctcttcctcttctccctcttgttctccctcttggtctcccttgtgttctctttcctgttctctgtttgcgacgtttcttcgactgtgtctcgctgacgtccgttctggtggcctgcgttttcgcctctgttcttcagaatggtggacgagaaggccggcggcttcgacgagtcggtctgtcactttttttccacggacgaggactgcgcgccttcgctgcccgggtcagacttcaagacgtcctcctctggagaatgcatgcgtggcggctgcggacgcacagactccggcgccgagcggcaggctgcgctgctggaggcggaacttcgccgtccgtcaccgaatcgaatctgggcgctggcgctcgccttccagctcgggtggacggtcgacgcgctccacgagaaaacgaaaatcgacaaatggtttttaagcaaacttcaaaacatcaacgacatcaagcgacagctcacccagctcaccctcgatgacctcacgcgcgcagatttcttctacatcaagaaatacggtaaacgccttcgcgcgctgtcgagacactggggcatgtggctcgggtgtcttcggggtggccgtcaaacagtggggtgtttcccagtcgcatttctcactcgtttgtacatctccgaaaacacggcgacgatgcgcaagccgaaggggacaagagacaagcgatgctccatgttttcaaagctcctgtctgttccccgtctcttgtggcaatcgtcgaagatacgctaaccgcagactggtggtcaaatgttttttttcgttttgggatccactgtggttctcatcttctcgtcgtctcttgtcttcgtctctcgctctcggcttctcgtcttctactcggtctcccctgctccgtttcttctcctcgtccgtgtctcatgttcctcttttcttctcgccttcttcgcttcgtctgtgcaacgaccagactgcgacaatccctccccgttagtaggataggccgcaggtttctctctgtttcccaggattcagcgaccgtcagattgcgcagtacttgatgaattcaccgagcgcggctgcgctgtcgcagttcgacgtgcgtcgtcggcgactgcacctgggcgtcagaccgtcggtgaagcaaatcgacactctcgcggccgagtttcctgctcacacgaattacctttacttgacctaccaaggaatcgacgacgacgtctcgcctctcgccgccacgccgtccgtctcggcggtcttcgctggcgcgcgagccgagaagagagaagaagaaaacgcagagacatgcagagacgacgaggacgaaagtctcctccgccgcctgagcaaaagctccagcgcgcggcttagaaccggcgaaggcgacgcacccggaaaacaatgttttgtggttctaggtaggcgacgaaggcaagaaactttgaggatggagagacgaagaagcattgaagggagagaaatgcaaagacgggagagagatcgagaaccggaggagaagagagaggaatggcgacagagatcaagggacgagttggagacgatgcatgaagcaaaggcgagcaaaaaaggcgattcacggaagaccagaatcagacgacaagaacatgtctttgtttatcgacgggcacacctctttttcttttctctcaaggacctgtcggtgcttgcgcaccaggtactgcgatatatatatatatatatatatatatacatgaacatccacagatatgcttgggtagatacagaagtacatatatatacatatatatacgactattcatgcatatgcatgtgtatatgcttttttgcacctttttgtgcgttggtattttttggtgtgtttcggcaggctgcggctgctaccgcataggatccagcgtcgagttcgattggtccgctgtttcgtgtgtccgtacacttcgctctcttggccaccacgcgattgtggtgagtattcgccgcctctcagtggtagatcacttcgcaaacgtttcggtccttaggtcaaggaatttgcgacaagcctctgcctcaggttcctcgtgaatagcctcagactatttttaaacaaatgcagcgatgcattaacgcatggggacactgcatgtgagatgagccacggttccgcgaatatctttatggatatgtatcaatggatacataaatatatatatatatatatacatatattatgtacgcagtggaggccatgtagaaatgggcatttttacctctattcacgaataagagtaggtctgtgcatgacgacgacggacatgaaagtgatgctagacagtatatgagcatttaaaaggtaattattcataaaagtgtttattgaacgttgttcgtcctgctcttgtcaattcgcattccgtggaacaggtaaactgcaatcccgagactgtgtcgacggactacgacgtgagcgatcggctgtatttcgaagacttgagcttggaaacagtcttgaacatctggtaggtttctcacgcgtagctgtccgattgtgggctctccgaatataagccgaatcgcggtgaccagcctggatgtcggccttggacgtgtgtctggcccctcagattccccgaacattcagagagagctcacatggcccgtaggtttggtgtctctcagtgtgtcatgcagtgcatcaaagttcgttctttgaattcgcacatcccgtcgatgtctgtgggtccgccttggatggcgccgcctcgttggtatttgaagtcccaaataagaggcacagaaatcactgttttcgctgtgtggaagacacgttcttttgtgtgtcccagatttctctcttcttgtctttcttctcacgcttctcttctgtcgtcatctgtgcctcgtgcacgcgtctctgaactcgtcgtattctcctctcttgctcgtgtctctttccctcctgtttgactttcttttccgtctcgcttcgcttcccttgttctcccgtcttgccctcctgcttcacgcgttgtctgtcacgtctggctttcgttggtcgcctctgttttccggagttttctcctcctccactctcttctttatctcagaaagactttgaagatttaaacaggggtccacctcctattctacactccggagaagaagtcataccttcccgcgcggtggtggattccattcgctatcctgtgtctcctgcctactagtcaagagatgttgcgcgagtgtgtgcttctcgttcgagggtcctctgtcgtgcgtttttcgttcgtttccagggacattgaagccccggcgggagtgattatttccgtgggcggccagacaccaaacacgctgtgctctgcactggagaagcagggcgtgaggatcgtcgggacgagtgtggcggcgatcgactgctgcgaggacagacacaagttctcccggctctgcgacgagctgaacatcgaccagccgaggtggaaggagttcaccgaccttcgcacagcgaaggccttctgccaagaggtaagcggaaacacatggttcattcggggcgaaacaagagaaaacgggagatggagatggggacgaaaacggagacgaacgagaagcaatcaaatggaaggcaaagcagccgagaaatagagagacacggagacgcagaaatgtgcgcagaggacagcgaaacgcagatgaagcggggggagacagagcggtcttcaacagcgcgcagtcgagttgaagaagagacgaacgaagaacggacgtcaaaacacacaaggggagcgaaccttggaggactgataacagaagacgaaaagtcgaattggaagataggaagtcgcaggagagatgacacaacctgtcgaggttccaaaggggtagcgtgtgcccaagagcaaaagcattcgccggatgtccttacaacgtgcttgctggcgcgacgacaccatcaggttacctcgaaagtaaataccgtttctgcatttttatcgaagaggtcttctgtctctgcttctggcctacgtaaaataaaaggcttgctctgtgaaagcccctgccggtccacatgttcgtaccgcacacgcttacagtggtgtcttgcatgcatttttcgctggccgtttttcttcctttcccttcgcgacggtctgtacgtacgcccgagaccccgttggtccacaggcgtccggcgcggtggtgtctctggtactccggcctcgtcgaacgtatgttttctcgcagtttgtctggcacgtgtttgaaaggctgtggattcgcaagtcgcgttttctgcgttcgttctcgctcttctctgcaggtcggctacccagtcctcgtgcgtccttcctacgttttgagtggtgctgccatgcgagtggtgaccgacgacgagcagctcgacgccttcctcaaaatcgcagctgtcgtcagtggcgaatctcccgtggtcatctccaagttcgtcgagaacgccaaggaagtaagaaaacgacctagacaggctcacgacttccacgcttccacgcatatccctgtatcgtgttcgtatctactttcctgtgggctacatgtctccgtgttcctatgcagtgatgtcagagatcttcctcgaaatactctcttcagctgcgtataggtgtatacttgcatgatatccatttatcttttgcttgcgtatctatgtagatggaaatgcatccgaatgggatatatatatatatatatatatatgcgtgtgttttcttataattatgtatatatatatataatatcgatgtgtgcaaacatgtgatctccgcttagatggggaactcttgagcaatagtgaggcaaacgaaacgaagttgtcaaaatcagcaggaaccaccgggatgaacctggtgcatgcttgcgtaagcataggcgtgcaagcatagtttcacatggtaggcaggagccggcattgttcggatgtatcgtcctctcctcgttccttccgtggaaactgcctttttggcttgcaggtggaatttgacagcgtcgcttgccggggggaaatcgtaaactttgcaataagcgagcatgtggagaacgcgggtactcactctggagacgcgactttgattctccctggacagaagctttacgtggaaacgattcggtgaggacgcatgaagagtgtgttgtgacacccgtccccagtgcgcgacagagaaaaagagacgaactttccaggaacgcagagagtcttcaaagattccgttcatgagtcgcggctggtgcatctcgcgcccattgttttcaaggacgctacgcgcccgaacgagtcgtgttctgtctcagcgtctccagttgctgaatgccgtggtgtcatcccagcaaacgcaactgtcgctcttgtcgagagcgcgagaaagagaacatgcgaaaagagcgtttgaagggagtggaggcggcacctgcatgtaatcgagagaaagaataatggcttagttgatgaaggacggtggagagaaagtgatcgaacttgaggcgcagtgagggcgcagagacagcgacaaagacatgtgaggatatccaggcaagtgtgatgggagagtcaggtagatatttgccagtggacaatattgctagaaatggagacaagatggatgcagggtgaacggacagttatcggtcggggtatacgagaaataaatgcatgttgaatgacttggatagatgagagagagagagggacgtagtggttccttggccttgcgccgccttgtcgtgaagggtcgacaccagtcagatggagattctgtcgcccacatcttctttagaagaattgaaaaagctgttcttgtaagttgtgaaggcacaaatgttttttgcgtgcagtcgcgtgaagaagatctcgcagaaactcgcgcgcgcactccaagtctcaggttcgtttttctcatacactatctttcgttgattgctcttcccctgcttctcctcaaaaacctttctttgcgtcgtgcgttcgatccggtgtcttctgcctttctgtcaggtgccaactgtacacggttcgagtttctgtcttctgagtcgagtgttcttcttcaccattttttcgtcggacttcgtgtcgctttgtgttatccgacagtcgatagacctcttttctccatcacgagaaagcgacgacgttgcctttcctatcgcagctcacccagtggaggcaaaccgcattggcggatctgcaattccaaaccagagttcagaggcgcctgagactgccggacgttccctcgagttcgtgtcagctgcatgcgttgcatgcgcatgcacagcgccagggacggggcacctgcgggtccgcttgcgagagggcgtgctgtgcttttctgcctttcttcaggtccgttcaacatccagttcatctgcaaacagaacgacgtgaaagtcattgagtgcaacttgcgagcgtcgcgtactttccccttcatcagcaaggccttcaatgtaaacctcatcgacctcgcgacaaagtaagaagaccaagggtattccacacgcgcctcaagttcccttttcaacacactcttcgacacacatctccgaataaacataatctgcgtgcatgtttctctagacaccgagagatctacacacgcgcatatgtatatacatatgtatatatatatatatatatacttacatatatacatacgtatgtgtgcgtatgattccactagaggcaaagctaccggtagggaccgattttgaggtggatttgtttcgttctttctcttcgtttccttgtcgtttcgtctccagggtgatgattggcgcaccggtcactccgttgccgattcacttgatggacctttccttcgtctgcgtgaaagttccagttttctctttcgcgcgtcttcgcggctgcgacccggtccttggcgtggaaatgcggtcgactggagaagtaagcaggctgctgaagaaggagacgctattccgttttcaagtcgggaagcctggcgtcgtttgaggcagatctgcattgccgtctactcggcttggaacgatagacagaggaagacacaagtgcgaggaaggggaaagggaggaaaacagcgaaagaggaggaaagaagagtacggcacaatgtgcgagcgaagcgagaagtgagtgagagtgtttagaagaacaaagtgagaaacgaaaatgaaacttctgggtatccttccctcaagcgactgttcgtggacaaacgcagttttcactcgagacgtcaacgcgttccgtctccattgcttgtctcctcgcgaccgtgttgcttttcctttcacaggttgcgtgcttcggagccagcaaacatgaggctttcctcaaggctctcatctcggctggtgtgccgctgcctcttgagaagcgaacgattctcatcagcgcaggtacgcaacgttctgtaaactaagcgattctttctgttcgctttctctctgtcgagcgacagcaaccttttcctgtctccttccctccctctcgagacagagcagcttccatgttccccttagtgttttttaacagccgcgtttctctgaagtcggcgcatgcatctactattgcagatttcgcttcgtgttcgtgcgagccgaagaaatgctgcccgtcgccctggcccttcgactctctctcctcgtcagtttcgctctctccatttccagctggcgaagagtttctatggacatatgtctgtcggtcgcgtgtgatgcatgcactgcctctcggttgtgacattttatcctcttgtctttgcaggccctctgtggtcgaagatggaactcgagccgtacttcaaaatccttttggacctgggcttcacaatctacgcaacggaaggtaagtggaggcgcactccatgaatccctttgcagttctctcttctttttcttctcacactaacagttggtgttcctatctatctacctacctctctatctatgtctctctggttgtctgtctgcctctcggtccgtgtatctgtgtatctgtcggtgcagctctctaagccgcgaacggtcgtgcgtatatatatgttcatctgcaacacaacgaacgctctgtatgcacgtgccatgtcgatatgactgtgtacgctggccgtcgttgtctgtgtgcaggtgtattgcttcgccgctgcagaacgtagcatatgtgtctttattcaacatttttgaagggatattgccttcggtttctttcagtggcatttagctaggattttttccttttttttgaaaggtagtgaagaacgtgtgttgacggccagggccgcagcacatgctgcgatgtctttcttttgcccatggtgtgtgtgtgtgtgtcttgtgtggtcgctttggcttttcttcattggactgtttttcgttttgtgtttcttccatttttccgttcttcaagtgcatgcgaaggttgtcaagcgtattctctcggaattggctttcacaaagctcttctgccccgctcctcgtttgtttccacctttcggcttctttttgttcaacgttcgcatgctcacacgcatgcacgcctcgatcttttcctgtcctgacgcagacaagtgctcttcgttttactgctgtccccgtttccgctgccccgccgtgacttctctcgttttgcgagttcacgtttcttctttcttcgtttttctggattttcttcggtgcccaggtacctacagattcctcatgaacagcgtcgttcgcgggcaggggacccacctgcctgggaacgcgtcgccggcgtccgacagcggccttcggactcctacgacagccgagtccgacgcagatgcgtgcattcgcgcgaaatacgcatcgcgcattattcgcgtgagaaagccgattgtcggatcgaatgagtcgcacaacggaggtcaccagtcacctcacgctctctccctcattgaaagtggtaaggcccggcagtgcgttttcgggtggctgtgcagacggggcatgcgattttttgcgtttctgagcaacgaggcgccagcatgtacacacagcccagtggtttatgtcttgtttgctttcgtgttgcagtcgcacatgcatgcactcttatgtgtatgcgcatctatcgtgccaaggtccattcacatgcctagttatgtgcatgcggaggttgagatgcatactgaggatggtcgatgtttaaacgattgttgacaggctcagctattgggagcgagcatggtttttctctgtgagagttcactggaccctagaccgtaaacacttgcagagactggctggaccccctcgatcgaaaccatgcatgcagcagtcaagtcgaccacagacagaaacagacgcacagcagtgccacggagatgtaggtgcggcgttcacggaggtagaggtgaacatgtggtttcacatggctttttgaattttttcgcaagaaggaaagtacgagaacttcctgctatgcacgaatcgctcatcctttcttgccgaagaacgaaacggtgtcttgtttgttcacatagggaaggtcgaaatggtcatcaatgtgcctgacagcatgaaccaccgagcggccacaaacggctacctgatgcgtcgcactgcgaccgactgcggaggtgcgttttgcctcagtgggcgcaacagacgaaccaaagaaacgaaagaaaagacagaaaaaaatggtggaactcgtgctctagcaaaacggactacccgacggaactgcaaagcgtctgtctggtccgagggcgtcttgccgttcccgactgggcgttcgaaaaaagcaagtcttctccatttcatgttttggcggcccgcgcaagcaacagtaatcttcactggcttggcccaccgactctcacgacctcagttcagtatgcgggcgcggggaatcaagtgcgaaatactcgttttctacataattatatatatatatatatatgtatatacgcgtacatagatataaatacggacatgtagacagatgtatgcatatgcatatatagttacaaacgtgtatagatttagacagattcgtaatattttgtgtatgtttcgatcaatacattaacgtttcgcttgcaatcagatgcgtcgatggcctcaacagtcgacagagcatggggtacgctgttttctggggtcgggaacgtttcagaaatctcgtcagagagagcgggcttctccgcgccattggcgtttgcgtgtctgcaatatgttgatcggcgtttacgtcgttttcttgtttttctcttcgcagttcccctcctgacaaacgtcaaagtggcaagcatgttcgtcgaggccctcaacaagaaagaagcgaaagaagctcagggtcgctccttctgggacattcgcagctgggatgaatactggcctcaaaaataa

SEQ ID NO: 4615 - protein, 1699 aa, Toxoplasma gondii
MGVHHALDDAGEMPHSGGRRAVAPIYPLDLAGRLRPAMLVLADGTEFLGYSFGYPGSVGGEVVFNTGMVGYPESLTDPSYEGQILVLTYPLIGNYGVPSSEKDEHGLPKYFEGDRIYVRALVVADYDNAAVTAHFRAENSLSAWMNTHKVPAIAGVDTRALTKHLREVGCMLGKIVVLSEEEERRSGLSLSALAALPSATAAEQRGENDATVTPDKAEARLRVERRQAALTMWEEAIRNKAKNLPWEDPNKDNLVALVSRKEVRVYKSTVVDPNLRDVLILCVDCGMKYNIYRQLLHSKFEHCNIILKVVPWDFDFGNDEFDGLFISNGPGDPERCEKTVANIRRVMERKIPIFGICLGNQLLALAAGARTYKMKYGNRGMNQPVIDLRTSRCYITPQNHGFAVDESTLPRDFLPLFVNANDRSNEGIIHRTLPFFSAQFHPEASGGPTDTFYLFGDFIASIMKAQTLKQVHTTPFSFPQKFQKVLLLGSGGLSIGQAGEFDYSGSQAIKALKEQNIFVVVVNPNIATVQTSQHMADRVYFLPVTDEFVTKVIEKEMPDGILCTFGGQTALNCAVKLHEQGVLAKFGCKILGSPIEAIIATEDRKVFAAKLEEIGEKVAESAAATNTEEAVQAAKAIGYPVLIRAAFALGGLGSGFAEDEETVRRICKEAFSHSSQVFVDKSLKGWKEVEYEVVRDCKNNCITVCNMENLDPLGIHTGDSIVVAPSQTLSNEDYYRLRDTALKVIRHFGIVGECNIQYALDPNSEKYYIVEVNARLSRSSALASKATGYPLAYIAAKLALGSTLVELSNSVTKETTACFEPSLDYVVTKVPRWDLRKFESCDPLMGSAMKSVGEVMAIGRTFEESLQKALRMVDEKAGGFDESVCHFFSTDEDCAPSLPGSDFKTSSSGECMRGGCGRTDSGAERQAALLEAELRRPSPNRIWALALAFQLGWTVDALHEKTKIDKWFLSKLQNINDIKRQLTQLTLDDLTRADFFYIKKYGFSDRQIAQYLMNSPSAAALSQFDVRRRRLHLGVRPSVKQIDTLAAEFPAHTNYLYLTYQGIDDDVSPLAATSSVSAVFAGARAEKREEENAETCRDDEDESLLRRLSKSSSARLRTGEGDAPGKQCFVVLGCGCYRIGSSVEFDWSAVSCVRTLRSLGHHAIVVNCNPETVSTDYDVSDRLYFEDLSLETVLNIWDIEAPAGVIISVGGQTPNTLCSALEKQGVRIVGTSVAAIDCCEDRHKFSRLCDELNIDQPRWKEFTDLRTAKAFCQEVGYPVLVRPSYVLSGAAMRVVTDDEQLDAFLKIAAVVSGESPVVISKFVENAKEVEFDSVACRGEIVNFAISEHVENAGTHSGDATLILPGQKLYVETIRRVKKISQKLARALQVSGPFNIQFICKQNDVKVIECNLRASRTFPFISKAFNVNLIDLATKVMIGAPVTPLPIHLMDLSFVCVKVPVFSFARLRGCDPVLGVEMRSTGEVACFGASKHEAFLKALISAGVPLPLEKRTILISAGPLWSKMELEPYFKILLDLGFTIYATEGTYRFLMNSVVRGQGTHLPGNASPASDSGLRTPTTAESDADACICAKYASRIIRVRKPIVGSNESHNGGHQSPHALSLIESGKVEMVINVPDSMNHRAATNGYLMRRTATDCGVPLLTNVKVASMFVEALNKKEAKEAQGRSFWDIRSWDEYWPQK

SEQ ID NO: 4616 - DNA, 6569 bp, Toxoplasma gondii
ctgttttcgtctccagagctgtttcaaatcaaagacgtccgcaggtcccgtcggttgtccctcggaagtacccctccccgtgcatgcgttttgcgcgcatcgacgagcccgcagcacagagtcatgcggtctgcggcgaagacctttggggaaaccgtcgctcagcgctaatcggtttgtccgttgatctgtcagagaaaactcccacctttttctccttttttgtttctgcttcacggcaccccccacactcgtcgatggttgcgtctgtgtctccgtctttgagcaagccgtgatttgctggccctcccccgcgccggttctcgcttcgcatttcttctctgcagcgcttcggccctgaaaccttcgtcgttccccacttcgagtgtcgtttacagttcctctttccgcctctcattcggcgaaccacgccccaactgctttcccccatatcggcggcgcctgtgcgacctccggtctccacgcccgcgcgacttctccgcctgctgtccgctcccgtgctgtccttctgcaccggatcttcctctggctgaaccttctgcccgtcttgtctctcgaattctcctctaccctcttcttgtcttcctgtctgcatcgtcgtgtctctcttgcgtggggcagcgggtgctgttgagtccggcgctacgtggctaagttcgcggacgccgcagagaaataccttggagcgttttttgacggcgaaggataatgggggtccaccatgcgctcgacgatgcgggggagatgcctcacagtggagggcggagagctgttgctcccatttaccctctcgatctggcaggacgtctgagacctgcaatgctggtgttagccgatgggactgagtttctcggatactccttcggctacccaggcagtgtgggaggcgaggtcgttttcaacactggtatggtcggctaccccgagtctctgacggatccttcgtacgaggggcagatcctcgttctcacataccctctcatcggcaactatggcgttccctcttcggaaaaagatgagcatggcctgccgaaatactttgagggcgaccgcatttacgttcgcgctctcgttgtggcggactacgacaacgcagctgtgacggcacactttcgtgcagagaacagcctcagtgcttggatgaacactcacaaagtcccggcaattgcaggagtcgacacgcgagcgttgaccaagcacctgcgcgaggtcggctgcatgctgggcaagatcgtcgtcctgagcgaagaagaagagcgtcgatccggcttgtcgctctcggctctcgccgcgcttccctcagcgactgcagcagagcaacgaggagagaacgacgcgacggtgacgcccgacaaagcagaggcccgcctaagagtggagaggcgacaagcagcgctcacgatgtgggaggaggcgatccgcaacaaggcgaagaacctgccatgggaagaccccaacaaagacaacctcgtcgccctcgtttcgcgaaaagaagtgcgcgtctacaaatctactgtcgtggatccgaatctccgcgacgtcctcatcctctgcgtggactgcgggatgaaatacaacatctaccgccagcttctccatagcaaattcgagcactgcaacatcattctcaaggtggtgccgtgggatttcgactttggcaacgacgaatttgacgggctcttcatcagcaacggtccaggcgaccctgagagatgcgaaaaaacagttgctaacattcgacgcgtcatggagcgaaagatccccatcttcggcatctgcctaggaaaccaactccttgccctggctgccggcgcgagaacgtacaaaatgaaatacggaaacagaggaatgaatcagccggtgatcgacttgcggacgtcgagatgctacatcacaccccagaaccatggctttgccgtcgacgagagcacgctgcctcgagatttcctgccgctctttgtaaatgcaaacgaccgttcgaacgaaggcatcatccatcgcacgctgccttttttctctgcacagttccacccagaggcgtcaggtggtccgacagacacgttttacttatttggcgacttcatcgcctcgattatgaaggcgcagacgctgaagcaggtccacacgactccgttctcctttccgcagaagttccagaaagttctgcttctcgggagcggaggcctgagcatcggccaagccggggagttcgactacagcggctctcaggcgataaaggcgctgaaagagcagaacatctttgtcgtcgtggtgaaccctaacatcgccacggtgcagaccagccagcacatggccgaccgggtgtacttcctgcccgtcacggatgagttcgtgacaaaagtcatcgaaaaggaaatgcccgacggcattctctgcacattcggaggccagacggccctcaactgcgctgtgaaactccacgaacaaggcgtcctggcaaaattcggctgcaaaatcctcggcagtccaatcgaagcgatcattgcgactgaggatcgaaaggtgtttgcggcgaagctggaagaaatcggagaaaaagtggcggagagcgcggccgcgacaaacacggaagaagctgtgcaagcggcgaaggccattggctaccccgtcctcattcgcgccgccttcgcactcggtgggctcggatctgggttcgccgaggacgaggagaccgtccgacgcatttgcaaggaagccttctcccattcttctcaggttttcgtggacaaaagcctgaagggctggaaggaggtggagtacgaagtcgttcgcgactgcaagaacaactgcatcaccgtctgcaacatggagaacttggatcccctcggcatccacacgggagattcgattgtcgttgctccttcgcagacgctgtctaacgaggactactaccgcctgagagataccgcgctgaaggtgattcgtcacttcggcatcgtcggcgaatgcaacatccaatacgcgctcgaccctaactcggagaaatactacatcgtcgaagtcaacgcgcgtctctctcggagcagcgccctcgcgtccaaagccactggctaccctttggcctacattgcggcgaagctcgctctcggctcgactttggtggagctcagtaactccgtgacaaaggagacaaccgcctgcttcgagccttcgctggattacgtcgtcaccaaggtgccgaggtgggatctgcgaaaattcgagtcgtgcgaccccctgatgggcagcgcgatgaagagtgtcggcgaggtcatggccattggacgcaccttcgaggagtctctgcaaaaggcgctcagaatggtggacgagaaggccggcggcttcgacgagtcggtctgtcactttttttccacggacgaggactgcgcgccttcgctgcccgggtcagacttcaagacgtcctcctccggagaatgcatgcgtggcggctgcggacgcacggactccggcgccgagcggcaggctgcgctgctggaggcggaacttcgccgtccgtcgccgaatcgaatctgggcgctggcgctcgccttccagctcgggtggacggtcgacgcgctccacgagaaaacgaaaatcgacaaatggtttttgagcaaacttcaaaacatcaacgacatcaagcgacagctcacccagctcaccctcgatgacctcacgcgcgcagatttcttctacatcaagaaatacggattcagcgaccgtcagattgcgcagtacttgatgaattcaccgagcgcggctgcgctgtcgcagttcgacgtgcgtcgtcggcgactgcacctgggcgtcagaccgtcggtgaagcaaatcgacactctcgcggccgagtttcctgctcacacgaattacctttacttgacctaccaaggaatcgacgacgacgtctcgcctctcgctgccacatcgtccgtctcggcggtcttcgctggcgcgcgagccgagaagagagaagaagaaaacgcagagacatgcagagacgacgaggacgaaagtctcctccgccgcctgagcaaaagctccagcgcgcggcttagaaccggcgaaggcgacgcacccggaaaacaatgttttgtggttctaggctgcggctgctaccgcataggatccagcgtcgagttcgattggtccgctgtttcgtgtgtccgtacacttcggtctcttggccaccacgcgattgtggtaaactgcaatcccgagactgtgtcgacggactacgacgtgagcgatcggctgtatttcgaagacttgagcttggaaacagtcttgaacatctgggacattgaagccccggcgggagtgattatttccgtgggcggccagacaccaaacacgctgtgctctgcactggagaagcagggcgtgaggatcgtcgggacgagtgtggcggcgatcgactgctgcgaggacagacacaagttctcccggctctgcgacgagctgaacatcgaccagccgaggtggaaggagttcaccgaccttcgcacagcgaaggccttctgccaagaggtcggctacccagtcctcgtgcgtccttcctacgttttgagtggtgctgccatgcgagtggtgaccgacgacgagcagctcgacgccttcctcaaaatcgcagctgtcgtcagtggcgaatctcccgtggtcatctccaagttcgtcgagaacgccaaggaagtggaatttgacagcgtcgcttgccggggggaaatcgtaaactttgcaataagcgagcatgtggagaacgcgggtactcactctggagacgcgactttgattctccctggacagaagctttacgtggaaacgattcgtcgcgtgaagaagatctcgcagaaactcgcgcgcgcactccaagtctcaggtccgttcaacatccagttcatctgcaaacagaacgacgtgaaagtcattgagtgcaacttgcgagcgtcgcgtactttccccttcatcagcaaggccttcaatgtaaacctcatcgacctcgcgacaaaggtgatgattggcgcaccggtcactccgttgccgattcacttgatggacctttccttcgtctgcgtgaaagttccagttttctctttcgcgcgtcttcgcggctgcgacccggtccttggcgtggaaatgcggtcgactggagaagttgcgtgcttcggagccagcaaacatgaggctttcctcaaggctctcatctcggctggtgtgccgctgcctcttgagaagcgaacgattctcatcagcgcaggccctctgtggtcgaagatggaactcgagccgtacttcaaaatccttttggacctgggcttcacaatctacgcaacggaaggtacctacagattcctcatgaacagcgtcgttcgcgggcaggggacccacctgcctgggaacgcgtcgccggcgtccgacagcggccttcggactcctacgacagccgagtccgacgcagatgcgtgcatttgcgctaaatacgcatcgcgcattattcgcgtgagaaagccgattgtcggatcgaatgagtcgcacaacggaggtcaccagtcacctcacgctctctccctcattgaaagtgggaaggtcgaaatggtcatcaatgtgcctgacagcatgaaccaccgagcggccacaaacggctacctgatgcgtcgcactgcgaccgactgcggagttcccctcctgacaaacgtcaaagtggcaagcatgttcgtcgaggccctcaacaagaaagaagcgaaagaagctcagggtcgctccttctgggacattcgcagctgggatgaatactggcctcaaaaataatttccaatgctttcgccaaaaacgttccatatctctcgctctactgacgcatttgagttacgcgacggatttccagcagtggctccgctgtatgcttcttcctctctctctaggcataatgatatatatatatatatatatatatatatatgcatatgtatgtgtacgtgtgtgggaacaccggcttgagaaccggttttcaagacgttgaaagtcgtctcatctttgttcctccacaactgagcatttgtctgtgtagatgcgcggctttgttcacatgtgtatcgacatctcagctgttacgtgtgctgatgtgaatagagcagcgagcgtacaagtagtgaatttgcctcagggtcttttggcgacggttggtgttgtcgaagcaacgcgcttgcagttgtgtgcatgcttgagccgatttgaaccaacaacctatttgtgcggtgccagtgttctgcaaagagagcgtcacgtcgggaatgcttcaaagccgaaacaaatggcatcgaaactctcgtcggatgcgagacatgcctgcacctcctgccgtcgcattccatttcgaaggaaagtcatcgcctcggacgccgagttctgattcacggaaaatatgcagactgtggcgtaaccattctctcagaagaaacacagatttctacaactcgaacttcgccttcttccataaacgtttcgtcaacatatttatacatacatagagatatacgtgtataagtaaa

SEQ ID NO: 4617 - DNA, 25556 bp, Toxoplasma gondii
ctgttttcgtctccagagctgtttcaaatcaaagacgtccgcaggtcccgtcggttgtccctcggaagtacccctccccgtgcatgcgttttgcgcgcatcgacgagcccgcagcacagagtcatgcggtctgcggcgaagacctttggggaaaccgtcgctcagcgctaatcggtttgtccgttgatctgtcagagaaaactcccacctttttctccttttttgtttctgcttcacggcaccccccacactcgtcgatggttgcgtctgtgtctccgtctttgagcaagccgtgatttgctggccctcccccgcgccggttctcgcttcgcatttcttctctgcagcgcttcggccctgaaaccttcgtcgttccccacttcgagtgtcgtttacagttcctctttccgcctctcattcggcgaaccacgccccaactgctttcccccatatcggcggcgcctgtgcgacctccggtctccacgcccgcgcgacttctccgcctgctgtccgctcccgtgctgtccttctgcaccggatcttcctctggctgaaccttctgcccgtcttgtctctcgaattctcctctaccctcttcttgtcttcctgtctgcatcgtcgtgtctctcttgcgtggggcagcgggtgctgttgagtccggcgctacgtggctaagttcgcggacgccgcagagaaataccttggagcgttttttgacggcgaaggataatgggggtccaccatgcgctcgacgatgcgggggagatgcctcacagtggagggcggagagctgttgctcccatttaccctctcgatctggcaggtcagtccgcagtttcgttcagacttccttctcgtctgggttctctgtttcacacgcctggccgcgtctcctctccgcttcttggtgtgcagcctcggtttctcccctttgatcagctgtctcggttgcgcttccgccccttgcgtcgccttccgtgtttgcttccaattttctcctggcttgctcgtgtgttcgcgcccctccggggagaccggcctgtctgctgccgacagagaggcagccgtgaagggcgtgatcatcaactgtctcgacggagagacacgacgtctgtgatgcaagcaaatgagcgcgtgtatgcacaggtacccgcgcatactcaaatattttcgtatctgcagatccacaggcgcatgcatgcgcccaactgtacccacgcgtgtttctacatagttgtggagaggcacatgcgtctgcatgtgtgcacgctgtctattcttgcgaacgataaacctggtggcgatccgtgtgttattttcaagaagtgatttcgacgcaggccatctcgctcgtcgctcgtttcctgtgtttgtcggctgctcgcaggacgtctgagacctgcaatgctggtgttagccgatgggactgagtttctcggatactccttcggctacccaggcagtgtgggaggcgaggtcgttttcaacactggtacgtttttctcgaatttgtccagaaacgctgacgtttggcgtctctcctctccagaaagggtgcattcggtctatccgctgtgtgctgcagcgattggtcttcctcttacaagcgcgtacaccaccctatgcagcctcatgcaccgccatctgtcaacgcgtgtgggccgccaccacacgaccatgtatctaccttcgataaacatatttatgcatatatatatatatatatatatacatatgcatgtagatactcaaaatgcatgcatattggtacgtctgttcacctgtatttttctgcgtgataattagatacccctgggttgcgtcaccatgagctgtgtatcgttctgggtgcatgcgttgttgcgggagtgttcgtgcgtcgggaaaggtagtggccgacttcttgtctttggcgtggttaggtatggtcggctaccccgagtctctgacggatccttcgtacgaggggcagatcctcgttctcacataccctctcatcggcaactatggcgttccctcttcggaaaaagtgagagcagacagcaagaaaacgaagagactagcagaaccccgtacttcgtggctgatccacatcagtgagagtcgaggagggagagtcggacttctcttgcgacgcaacgtcacaggaaagcaagtctggcaggggtctccgctttctcacatgccgaatgcgcacacaaatcattcatacatcactacaaaactgagtcctacgtgagaagagcaacgtcacctctccgtgagacatatacgtgtttctatatacatatatacatattatgtatatatttatattcaaatatatatatatatatatatcaatgtggatatctaagtttatatatgaacgtacatctgtctttcgggagagtatttccctaaatggcagatgctaagacgcttgtacacctgcgtgcaaaggtgtttacgcgggtgtctacacgtgagcgaagtgattgctacacacatgtatatatatatatatatatatatgtatgtatgtcgctttacaatgtttgtttttctgtacatctaaagtcgtctaggcatcgatatgtgatgtgcatttcagcgtatttcgtgtgtttcatttccgctcttcaggatgagcatggcctgccgaaatactttgagggcgaccgcatttacgttcgcgctctcgttgtggcggactacgacaacgcagctgtgacggcacactttcgtgcagagaacagcctcagtgcttggatgaacactcacaaagtcccggcaattgcaggtgcgaaaacatcgaggccgaagtgtctgtagtgtcagatgcgcctctggacaagacatcctctttcgatgcttgtctttgattttcacttaattttctcttcgcaagtctgcgaaggaacgtctgtctgtacatctcgatgcccaggtggctttctcggccatttggaggaactgtcttggatccgcgtagtaggcatgtatgagggagcagcttctctttcttctgaattgtgttccacttgtaagtcggttcgaccacgagcagtcaagacgctcttaccgtgccaccgagtcaacgtcgcccatcacagaccggcttttgaatgcctttttcttcaggctccattaatgcacgtctcactgaatccgtgctcgtcaatttggacagctagatctgtgtagtccctagagactaacttttggagggagactaacaatacagctaggttgctctacctcggctatgtttaacgcatagttcacggatcactgttgccactggtccttacagagagagcacacgactgctcacgtgtttgtcatggagacacatctcgattgtgtatgtttcacttcaattctgcagagccgttcagtgtatgtctgccatgacggggaggggtatctcaagggtgtattgtgaactgtatttccacggtgtacggggcttgaagtactggcgcacatatgtctggaggacgagacgtggtttagttcgtgtctcagtgctcaacagcgtccggatctctggcatgctgttgccatcctgttagttgctggccttcgcggctactcgttctcctttaggtgcacctccagtgtctccagttctgctggtgttcccttgccgactgttgctgctctgtcagggctttctaggtccccgcctcactctcgtttccgcttctctgttttctgcgtccgtgtgtgtctcacctcttcctcttcgtttccatctcttttcttgtctcacctttccacggctctcgtttgctcttgaaacgctgtcggttgtcgtcgttccgcctcgttctctattccgctctatcttcgtcgttcctcttttgcttctttccgacttcccgactcctgcctgtttccggctgtatcgttttctttttcaaggagtcgacacgcgagcgttgaccaagcacctgcgcgaggtcggctgcatgctgggcaagatcgtcgtcctgagcgaagaagaagagcgtcgatccggcttgtcgctctcggctctcgccgcgcttccctcagcgactgcagcagagcaacgaggagagaacgacgcgacggtgacgcccgacaaagcagaggcccgcctaagagtggagaggcgacaagcagcgctcacgatgtgggaggaggcgatccgcaacaaggcgaagaacctgccatgggaagaccccaacaaagacaacctcgtcgccctcgtttcgcgaaaagaagtgcgcgtctacaaatctactgtcgtggatccggtgagtgacagagcccagggaaagacgtttcacgtgcgaaagcgaaacgcagtttccacagtccatgtttagatttagcgtgggacatgcacaagttgggattctgcggaatgccgctatctggggaggggagtatagacgccgagttcaactcctggcttcaatctccactcaaccgaggcgtagcgcaatgcgctcgcttgcactggtttcgccgcgccggaggtccgtgctgagctgtacgtacatccggggtgtgtatgcacgttgcgatcgcgtttgagtcttttgagggtctgactgtgcgtgtccggggcctcccgggcggcgcctgtcgaatgtgcggctcggctttgcccgccttctttctccaaagtgtgtctggactgcctttctgtgttctgtcggaatctcaagtctgggctgtcggtttcgttgcctgaatctgcagaatctccgcgacgtcctcatcctctgcgtggactgcgggatgaaatacaacatctaccgccagcttctccatagcaaattcgagcactgcaacatcattctcaaggtagagctgtcgctgctctgactgcattgactttgaaactctcattcctgatctgttagctctcccggcagttcgcttgtattttctgtttcctgtggcgcccacccgtcaattcccctttctgcggcgccgagcgctcttcagctggtactgggaaatggagatgtgtgtccagcagtatcaagacatacataagtatactgatgtgtacacgtgaatctccattctgtttatgcatgcatatctgtctatatatatatatatatatatatatatttgtacatggatttatgtgtgtgcttgcgtttgaatatatgtacgtattatctacaagtctgcatgtttccgtacgaatgtctgcacgcgtgtgtgtctggttacatgccgctgaatctcactattcaattaaacagttgagtgtggagaggtacgcgagactgtgactgcgcagctgtgaaaccgttcaggagcgcatgcgctttgcgtgtctctcaggtggtgccgtgggatttcgactttggcaacgacgaatttgacgggctcttcatcagcaacggtccaggcgaccctgagagatgcgaaaaaacagttgctaacattcggtgtgtgctgcagagaaaagccgattcgttcgccagagtcaggaacagcacagtggcgcatttccatttccgtcttcgctgtagacatgcaaaaccatcgcgatgtgcagattggttgagcttgctctctgagtcgcgggaaactgttgcttccgttccttggcgacccaggcacagagaagcgtgcatgcaaaaaacaacttggagtctctccgttttgtctctgctaacttagtagaacttagacccggcaaacagcgacatgcacgagttaaacgcgtagttgctccggttcgggccaaggtgaccggaatgcccggtggctgccgggtactatgcgcttccccgcggatctcccatgttctcttgtgtgggaagactgcgcagcactgctggtggctgcgtaggttcatgcccttacaatgcaaatcccttttataccgttcgttctccctcccgttttcagacgcgtcatggagcgaaagatccccatcttcggcatctgcctaggaaaccaactccttgccctggctgccggcgcgagaacgtacaaaatgaaatacggaaacagaggtaagcgttgccgttcgtcgggcacactgattgtactccgtttcgggtgtacgtacacctctttcaccggcagcgaggcgccggtccagggagcgtcccgcgacgtgggtggcaggccagtgactagcgacggcgaggtgaagagggaaaatagcatctccggactctcatttccgttttgccgttgcaggaatgaatcagccggtgatcgacttgcggacgtcgagatgctacatcacaccccagaaccatggctttgccgtcgacgagagtaagcagcgacaaaattccacctgcgaaatctaggtgccatgacctccatatgccgttatcgtagacataatgttgatatgtagatgcatatggatacgtcgagagaggtacagattcactttcttagatgtagacggctataaatcaaagtggttcatgtatctgcaattggttgtatttcgacagcattgtgaaagggagcggtgttcggtagagcgcaaatgtgacgcaagtgtatccgtaagaccctgagtttcattataagtaggtattgtctctgtacaaatgatccgcgagccagagctgtataactcaaatcgaataaacagagtgtctgtcgctgtgtatacgaatggtaacagtaatccatatttcacgcctagaacataaccgatgtggaataacctaaaaatgtgtgtttgagccgtccacatcagcgatatgtcgattttgaatcagcgaagtcgacgtttgtccccgttgatgaagttcaacaatgagccagatattcactttctagaacctccacaaaggatgatgtcctccaggtagcgaagataccaactgtggtgttggagaatggcgtttcaaagccggtagcgttgcagacactcttgtgtcctcgtgggagtccgtgttcgaggcgggcagttgctacagcaagtagatgcatagaacgaagcgagacctccacgcggggatataccttttgacatcagttctggacgactgcagatcctttgcacagatgcaatatctgcgtacggtgtggcgcttacaatacatggtcgagctatactcctgtcggtctcagtgcggccttcgtcagatgacagatgtggacacctgcctatacgaccctgtgttgaacctctcgccgtttctgcaggcacgctgcctcgagatttcctgccgctctttgtaaatgcaaacgaccgttcgaacgaaggcatcatccatcgcacgctgccttttttctctgcacagttccacccagaggcgtcaggtaaggcggcaatacttcttcgactgaaataccgacgttgcagatcagcgacatctatttccgttggcgtcgtttcaatgatcagtgcttgaaggcatcttggcagcgtttcgtcggatcaatacggcggaactggagctcgacggtacaaggaataagtgactgccgatgctcttcccgatgaggcaggggcgacagttcctttcatgagggaaacatgtgcttgtgtcatcagttcagttcctcataactggaggcatctgttgggtcttaaataaagccgtcactctcgctaagaaggatgctgccttgcgacgcaactcgtgtgtcaccaactgcatcgcggtgggagagtttttcctctgagacaagacgaggatggacctccgaagttcgtgtacgcagtctgcgagtcagtggggtgccgacgcacgagacgaagacgagccactcagagatgattgtttctcacttttctgcctcggcgaagaagcagcgcatacccatcggtgcccctccgctgggcgtctcgtgcgttccctgtcgctggcgcggcttcgtcaacacagtgcaccgattttttcttctgctcgtttgtgacaacctagagagctccagtgagatcgaggagtggcgcgagatgtgagtttcacgcggtggaggccagatgatgtttcgtcaagagctgcgccgcagtctaccacgcagcgcagaccccgtggggtgtgtccttcgcgcgattctttcctggagtctgtggggtgtttatacactcggcgtccctctgtctgtgccttctggctcaggtggtccgacagacacgttttacttatttggcgacttcatcgcctcgattatgaaggcgcagacgctgaagcaggtccacacgactccgttctcctttccgcagaagttccagaaagttctgcttctcggtaaggcgatgttcctcccgcatcttgagggaaggcgagttcttttaacgtgcagaaagccctttgcgggggtcaccagagaaggaacgccatcggctgcatccttcttggtttctcgcagatgcgtctgtggctggccgtcgcgtggcaccttctgaacgcccgtgtggaggtttcccgacgctgtcatctctgtcaaggtgtcgtcgtggacgttcaagagtgcgagcgcggccctgccgactgtcgcagagagcgcggctcatgtcatgtctcccttgtgcattctccctgagcttttcgcgggctctctttcgacctctgtctccgccgggatcatctgtttaggaggaccgtgtcgtggtgactgtgccggaggctctgctcgctcaagtgaggaggtcggggtaaggcgggaagtcggctgtgtgtgcgtggtttatttgcttcgtagggagcggaggcctgagcatcggccaagccggggagttcgactacagcggctctcaggcgataaaggcgctgaaagagcagaacatctttgtcgtcgtggtgaaccctaacatcgccacggtgcagaccagccagcacatggccgaccgggtgcgttgaccgcgcagacggattgcgcagagtggcgtcgagggagcgcgaacgaaaaaggaggacgcagacgccagagaagacacagagaatcagagagacagcgagagacagacagcgagacagaagatcaatcgggaggcaaggaggagagcgaggtagagagaaaccgcgagaaacacagagaggagcagagagctaacaagacagaaacaaagcgtggtgcaggaagacgcagatgagagggagagacggagcccagagcagagacagaaagacagagcaacgagagacacagacagaacggagagagagagataagggtggaggtgaaggaataaaggcggggcttgagcaaacggtgaagcattaggctgtggaaggtgacgaaagcgcgatggaggcaggatggtctttgtgaggccttctttgtcggaagaagagagtggacaccacgtatttccactgctgcgttgcgtaacgcgtttatgagagggttctgcggttccccagagactggcggaaaccaaggagtcggcaggcttcctcgggtctctctctcctctgcgttgtgagcttcctaacgtctgtcgacttcgggaagtccgaaactctccggagaagacacacgcaactccaaactgcgagtggagttgaaccgatccagtcgagtagtagcttgcatgaaatgtgtcgagccgggtgcatgcaattcattttttcaggtgtacttcctgcccgtcacggatgagttcgtgacaaaagtcatcgaaaaggaaatgcccgacggcattctctgcacattcggaggccaggtgcgtttgcgtgtgtgcaacggctttttcctcgatgaacgtaactaaatgcgcgaagatataacgaggcctaggcactcgcaaatggacaatccatccatatgcatatatattcatatatatgcatgtttaatatatatatatatatatatatatataatatgcgtatggggctggccattgaggagatatgtatgcagctgttcagaggagtagcgtaggcgaacacgtttgcatgcatagacttctggacgaagcacgtgatcgtgcggatatatgtaaatgaggttgtgggcgtatgtggggacagcgatatctggacagggtacggcttttttttcactttatggcatgttcagacggccctcaactgcgctgtgaaactccacgaacaaggcgtcctggcaaaattcggctgcaaaatcctcggcagtccaatcgaagtaagaatgtattcatatatatacatccatatatatatatatatagatagatagatattcgtaactgcataaatgcacatattcatagtgatacatatatatatgcacatagacatatgcaagtacatccgcgcacacatatgtccatatatgtgtgtatatccatatataaatatatatccatatatatatatatatatatatatatgcgtgtagagaaatgtgtgtgtatcagtgcaagttacgatgcacaaatttgtatactggtgtgtatttaggtatccgcgcatttcgagtttcgtgggaagcacgcggtttcttgtttgtcttttttaggcgatcattgcgactgaggatcgaaaggtgtttgcggcgaagctggaagaaatcggagaaaaagtggcggagagcgcggccgcgacaaacacggaagaagctgtgcaagcggcgaaggccattggctaccccgtcctcattcgcgccgccttcgcactcggtcagccaaagaagagaccggggagtgaagacgagcgaagaaaaggaggcgcaaggtcaacgagagcaatgagaggagacccagaaaaggcgcacacagaacggatgcagacggaaacagacgaggcggcaaaagaggcagtcgatgacagagaagaatgcgaggaaggacgcgagggagacggaagcaccgaagacgaagggaagagaactggccagaaacgaaggatacggatttcacgttcaagtgatgtcaacttgtatgtggactatcgcaggtgggctcggatctgggttcgccgaggacgaggagaccgtccgacgcatttgcaaggaagccttctcccattcttctcaggtccggtcaacttctcgtagtgcatgcgtatacgcacatcagagtaaaatttgcatatatatatatatatatataagtatatgtatgcacacatatatgtttcagttcttatctgcgggtgtacttgtgcatgtccgcaccggcgtcgtgtgggcagatgtgaacgtctggagagagaggtcgcccgttctgaatgcgcgtgcatgcgtttctgacaggcgtgtctgcatggctgcggaagccgaatgaaaccccacacttccgaaggaatctcgcgtttcagccggttcgtttgcaggccgagtgtcgtcggggaggcttcctcgttgtgttggtgtgtgccggtccagtggttctcgcgcgaagccccgagtgcgtcccctataagactgaaaagcgccaagtcgagctggcggaactctgagaatttacgttttttcaggttttcgtggacaaaagcctgaagggctggaaggaggtggagtacgaagtcgttcgcgactgcaagaacaactgcatcaccgtctgcaacatggagaacttggatcccctcggtgcgtctcgtctgtgtgcatttgccgtgtttgctcttcaactgtggcttctcagctctgtcgaggggtgcgctgcggaggctcgctgtacaccacgaattgtttctggcctctctgttaacgagcgttctgaaacgaatccccacacaagtgcatgctccctctcgtcctctcgctgcttgactctgtcgctgcgggggaatccctcgtaccgtgctctcgctgtgacgacctctgagtggacgcgtctctctcggacttctctttgtctctcgccagacgcagtgattccaagtctctctctttttgtgcagcgctgtctctgacgaacgctgtctatcggcgtatctctccttctccgcttctccagagcttggcacttctctgtataaagatttacatatatatatatatatatatatatatatatatttgaatgtttttgtatatgcactccatctggataattcagtcgtcgaactctattgtcacagcgttttggtcacttaaaacggcgtccttcgtcgatggtttgcgcatgcgctttttgcgtccatgtctgtacacccgcgtgtggattttttcccctcaggcatccacacgggagattcgattgtcgttgctccttcgcaggtgagctgtcttcgcttgtgtttttctgtttttcatctctctttatacatttctcggtccgatatttctgctctctcatggcctctcttttgccattttcctcgttgttttctcttatccctcgttcttcctcttgttatgtcttcttcttatcctttgttatcttttgtccgcgttggtctattgttgtctccgcttcaaatcccttcgtctcccacacaagcgcgcgttttcttctttgctctctctcttcagacgctgtctaacgaggactactaccgcctgagagataccgcgctgaaggtgattcgtcacttcggcatcgtcggcgaatgcaacatccaatacgcgctcgaccctaactcggagaaatactacatcgtcgaagtaggtgacaagagagtgcaaacgaaaaaccacgggaggcgaagggaacgcggtcttacagaggatgatgccgcgaggaaaggcggacgaacaccctgaaacaggagagaggaaagcgagaaccggacaggctcacaccaaagtcagacagaggccacagagcgagaaggacagggaggtgcagaagcggagagaccggccagaaaagagagagacaggggcggagataagtgctacagaaaatcgagagaagctttctcgatcctagctcaggttcgatgtcacctgcctcgcgctgtgcggcatggccacacgcatgctgaaagtcaacgagaaggtcgccaagcagttctacaaatcaagcactgtccagacagctgctgacggacattccgtttttccttttgtgggcgtttgtgtggctgtctccgacgttcggacgtcccgcgattacagcgtctctgactttccagacgcctcgctttctcatctcttctcccgcttcgctgtcttgtgggccttttcctcaccgcaggtcaacgcgcgtctctctcggagcagcgccctcgcgtccaaagccactggctaccctttggcctacattgcggcgaagctcgctctcggtaacgtttgtctcccttctttttcgtcgaaacttctgagtggcttttccgaactgttcgtcccagagtcgatccgcatggcccgctcaaagcccagcatcccctttcattgctgctctccttgatgcttcaaacgtgtctgcacggccttccttctgttcttaaattcgcggcggtgatgtgcgtttccgtctaatcttctttgtctcgtcggctgagtgaggtggtgcttcggtcggttttcatcctcgagaactggcagtgtgtgtcgcatgttttctctctccatgtaggctcgactttggtggagctcagtaactccgtgacaaaggagacaaccgcctgcttcgagccttcgctggattacgtcgtcaccaaggtgccgaggtgcgaggacacaacgcacacagatagaagttccatagggactcccaggacaccagtggtttcttccctcttctcttcgtggcctgactgctccctcgttctctctttcctgcctctcttcatctctttctctgtttctctcttcgttgttcctgtccttcgccgtctcttccgctgttcgctgttggggtccgttccagttcggccgtcgcttgcgtgtcaacgtgtgtatggttctctctcctcaacgtcaccacgtcgcctgcgtccttgcccaaaattgtttctgccttctgcaggagctcaacgccttctgttagatgcctctctgacgcatgctttgcatctctgcactcgatagagacttgccgttttgaggaagaagtttccagagcgtctgagagagtgtcctcgctcgtctctcgacgtccagcgaggcttgcgcctcctggcggtgaacagattcgtgttgaatatgtctttctgctctcaggtgggatctgcgaaaattcgagtcgtgcgaccccctgatgggcagcgcgatgaagagtgtcggcgaggtcatggccattggacgcaccttcgaggagtctctgcaaaaggcgctcaggtaaaccacaaagttccaatcatcggcatccgtcgacaaacagttgtcccagttgaagttactgtagccacatctctcttctccgcatttcctctctcttcctcttctccctcttgttctccctcttggtctcccttgtgttctctttcctgttctctgtttgcgacgtttcttcgactgtgtctcgctgacgtccgttctggtggcctgcgttttcgcctctgttcttcagaatggtggacgagaaggccggcggcttcgacgagtcggtctgtcactttttttccacggacgaggactgcgcgccttcgctgcccgggtcagacttcaagacgtcctcctccggagaatgcatgcgtggcggctgcggacgcacggactccggcgccgagcggcaggctgcgctgctggaggcggaacttcgccgtccgtcgccgaatcgaatctgggcgctggcgctcgccttccagctcgggtggacggtcgacgcgctccacgagaaaacgaaaatcgacaaatggtttttgagcaaacttcaaaacatcaacgacatcaagcgacagctcacccagctcaccctcgatgacctcacgcgcgcagatttcttctacatcaagaaatacggtaaacgccttctcgcactgtcgagacactggggcatgtggctcgggtgtcttcggggtggccgtcaaacagtggggcgtttcccagtcgcatttctgactcttttgtacatctccgaaaacacggcgacgatgcgcaagccgaaggggacaagagacaagcgatgctccatgttttcaaagctcctgtctgttccccgtctcttgtggcaatcgtagaagatacgctaaccgcagactggcggtcaaatgttttttttcgttttgggatccactgtggttctcatcttctcgtcgtctcttgtcttcgtctctcgctctcggcttctcgtcttctactcggtctcccctgctccgtctcttctcctcgtccgtgtctcatgttcctcttttcttctcgccttcttcgcttcgtctgtgcaacgaccagactgcgacaatccctccccgttagtaggataggccgcacgtttctctctgtttcccaggattcagcgaccgtcagattgcgcagtacttgatgaattcaccgagcgcggctgcgctgtcgcagttcgacgtgcgtcgtcggcgactgcacctgggcgtcagaccgtcggtgaagcaaatcgacactctcgcggccgagtttcctgctcacacgaattacctttacttgacctaccaaggaatcgacgacgacgtctcgcctctcgctgccacatcgtccgtctcggcggtcttcgctggcgcgcgagccgagaagagagaagaagaaaacgcagagacatgcagagacgacgaggacgaaagtctcctccgccgcctgagcaaaagctccagcgcgcggcttagaaccggcgaaggcgacgcacccggaaaacaatgttttgtggttctaggtaggcgacgaaggcaagaaactttgaggatcgagagacgaagaagcattgaagggagagaaatgcaaagacgggagagagatcgagaaccggaggagaagagagaggaatggcgacagagatcaagggacgagttggagacgatgcatgaagcaaaggcgagcaaaaaaggcgattcacggaagaccagaatcagacgacaagagcatgtctttgtttatcgacgggcacacctcattttcttttctctcaaggacctgtcggtgcttgcgcaccaggtactgcaatatatatatatatatatatatatatacatgaacatccacagatatgcttgggtagatacagaagtacatatatatatatatatacatatacgactattcatgcatatgcatgtgtatatgcttttttgcacctttttgtgcgttggtattttttggtgtgtttcggcaggctgcggctgctaccgcataggatccagcgtcgagttcgattggtccgctgtttcgtgtgtccgtacacttcggtctcttggccaccacgcgattgtggtgagtattcggcgcctctcagtagtagatcacttcgcaaacgtgtcggtccttaggtcaaggaatttgcgacaagcctctgcctcaggttcctcgtgaatagcctcagactatttttaaacaaatgcagcgatgcattaacgcatggggacactgcatgcgagatgagccactgttctgcgaatatctttatggatatgtatcaatggatacatatatatatatatatatatattatgtacgcagtggaggccatgtagaaatgggcatttttacctctattcacgaataagagtaggtctgtgcatgacgacgacggacatgaaagtgatgctagacagtatatgagcatttaaaaggtaattattcataaaagcgtttattgaacgttgttcgtcctgctcttttcaattcgcattccgtggaacaggtaaactgcaatcccgagactgtgtcgacggactacgacgtgagcgatcggctgtatttcgaagacttgagcttggaaacagtcttgaacatctggtaggtttctcacgcgtagctgtccgattgtgggctctccgaatataagccgaatcgcggtgaccagcctggatgtcggccttggacgtgtgtctggcccctcaggttccccgaacattcagagagagctcacatggcccgtaggtttggtgtctctcagtgtgtcatgcagcgcttcaaagttcgttctttgaattcgcacatcccgtcgatgtctgtgggtccgccttggatggcgccgcctcgttggtatttgaattcccaaataaggggcacagaaatcactgttttcgctgtgtggaagacacgttcttttgtgtgtcccagatttctctcgtcttgtctttcttctcacgcttctcttctgtcgtcatctgtgcctcgtgcacgcggctctgaactcgtcgtattctcctctctggctcgtgtctctttccctcctctttgactttcttttccgtctcgcttcgcttcccttgttctcccgtcttgccttcctgattcacgcgttgtctgtcacgtctggctttcgttgatcgcctctattttccggagttttctcctcctccactctcttctttatctcagaaagactttgaagatttaaacaggggtccacctcctattctacactccggagaagaagtaataccttcccgcgcggtggtggattccattcgctatcctgtgtctcctgcctactagtcaagagatgttgcgcgagtgtgtgcttctcgttcgagggtcctctgtcgcgcgtttttcgttcgtttccagggacattgaagccccggcgggagtgattatttccgtgggcggccagacaccaaacacgctgtgctctgcactggagaagcagggcgtgaggatcgtcgggacgagtgtggcggcgatcgactgctgcgaggacagacacaagttctcccggctctgcgacgagctgaacatcgaccagccgaggtggaaggagttcaccgaccttcgcacagcgaaggccttctgccaagaggtaagcggaaacacatggttcattcggggcgaaacaagagaaaacgggagatggagatggggacgaaaacggagacgaacgagaagcaatcaaatggaaggcaaagcaaccgagaaatagagagacacggagacgcagaaatgtgcgcagaggacagcgaaacgcagatgaagcggggggagacagagcggtcttcaacagcgcgcagtcgagttgaagaagagacgaacgaagaacggacgtcaaaacacacaaggggagcgaaccttggaggactgataacagaagacgaaaagtcgaattggaagataggaagtcgcaggagagatgacacaacctgtcgaggttccaaagcggtagcgtgtgcccaagagcaaaagcattcgccggatgtccttacaacgtgcttgctggcgcgacgacaccatcaggttacctcgaaagtaaataccgtttctgcatttttatcgaagaggtcttctgtctctgcttctggcctacgtaggataaaacgcttgctctgtgaaagcccctgccggtccacatgttcgtaccgcacacgcttacagtggtgtcttgcatgcatttttcgctggccatttttcttcctttcccttcgcgacggtctgtacggacgcccgagaccccgttggtccacaggcgtccggcgcggtggtgtctctggtactccggcctcatcgaacgtatgttttctcgcagtttgtctggcacgtgtttgaaaggctgtggattcgcaagtcgcgttttctgcgttcgttctcgctcttctctgcaggtcggctacccagtcctcgtgcgtccttcctacgttttgagtggtgctgccatgcgagtggtgaccgacgacgagcagctcgacgccttcctcaaaatcgcagctgtcgtcagtggcgaatctcccgtggtcatctccaagttcgtcgagaacgccaaggaagtaagaaaacgacctagacaggctcacgacttccacgcttccacgcatatccctgtatcgtgttcgtatctactttcctgtgggctacatgtctccgtgttcctatgcagtgatgtcagagatcttcctcgaaatactctcttcagctgcgtataggtgtatacttgcatgatatccatttatcttttgcttgcgtatctatgtagatggaaatgcatccgaatgggatatatatatatatatatatatgcgtgtgttttcttataattatgtatgtatatatatatatataatattgatgtgtgcaaacatgtgatctccgcttagatggggaactcttgagcaatagtgaggcaaacgaaaagaagttgtcaaaatcagcaggaaccaccgggatgaacctggtgcatgcttgcgtaagcataggcgtgcaagcatagtttcacatggtaggcaggagccggcattgttcggatgtatcgttctctcttcgttccttccgtggaaactgcctttttggcttgcaggtggaatttgacagcgtcgcttgccggggggaaatcgtaaactttgcaataagcgagcatgtggagaacgcgggtactcactctggagacgcgactttgattctccctggacagaagctttacgtggaaacgattcggtgaggacgcatgaagagtgtgttgtgacacccgtccccagtgcgcgacagagaaaaagagacgaactttccaggaacgcagagagtcttcaaagattccgttcatgagtcgcggcgggtgcatctcgcgcccattgttttcaaggacgctacgcgcccgaacgagtcgtgttctgtctcagcgtctccagttgctgaatgccgtggtgtcatcccagcaaacgcaactgtcgctcttgtcaagagcacgagaaagagaacatgctaaaagggcgtttgaagggagtggaggcggcacctgcatgtaatcgagagaaagaataatggcttagttgacgaaggacggtggagagaaagtgatcgaacttgaggcgcagtgagggcgcagagacagcgacaaagacatgtgaggatatccaggcaagtgtgatgggagagtcaggtagatatttgccagtggacaatattgctagaaatggagacaagatggatgcagggtgaacggacagttatcggtcggggtatacgagaaataaatgcatgttgaatgacttggatagatgagagagagagggacctagtggttccttggccttgcgccgccttgacgtgaagggtcgacaccagtcagatggagattctgtcgcccacatcttctttagaagaattgaaaaagctgttcttgtaagttgtgaaggcacaaatgttttttgcgtgcagtcgcgtgaagaagatctcgcagaaactcgcgcgcgcactccaagtctcaggttcgtttttctcatacactatctttcgttgattgctcttcccctgcttctcctcaaaaacctttctttgcgtcgtgcgttcgatccggtgtcttctgcctttctgtcaggtgccaactgtacacggttcgagtttctgtcttctgagtcgagtgttcttcttcaccattttttcgtcggacttcgtatcgctctgtgttatccgacagtcgatagacctcttttctccatcacgagaaagcgacggcgttgcctttcctatcgcagctcacccagtggaggcaaaccgcattggcggatctgcaattccaaaccagagttcagaggcgcctgagactgccggacgttccctcgagttcgtgtcagctgcatgcgttgcatgcgcctgcacagtaccagggacggggcacctgcgggtccgcttgcgagagggcgtgctgtgcttttctgcctttcttcaggtccgttcaacatccagttcatctgcaaacagaacgacgtgaaagtcattgagtgcaacttgcgagcgtcgcgtactttccccttcatcagcaaggccttcaatgtaaacctcatcgacctcgcgacaaagtaagaagaccaagggtattccacacgcgcctcaagttcccttttcaacacactcttcgacacacatctccgaataaacataatctgcgtgcatgtttctctagagaccgagagatctacacacgcgcatatgtatatatatatatatatatgtttgtgctcgtagggtcgatgtggcgggagcatgtcgcagatgtttttcagtttacgatacttttgcatttttgtctcgtcctctgtagcgctccccggcatgcagatgcatgtgcatgcctgtatctgtcagtacgtggtgcatgtgcgtttctacggattttttcctcatggtgtgtctctgcaccccagcatatatagagagagacatgtatatacatatgtatgtatatatatatatatgtatatatatacatacatacatacgtatgtgtgcgtatgattccactagaggcaaagctaccggtagggaccgattttgaggtggatttgtttcgttctttctcttcgtttccttgtcgtttcgtctccagggtgatgattggcgcaccggtcactccgttgccgattcacttgatggacctttccttcgtctgcgtgaaagttccagttttctctttcgcgcgtcttcgcggctgcgacccggtccttggcgtggaaatgcggtcgactggagaagtaagcaggctgctgaagaaggagaagctattccgttttcaagtcaggaagcctggcgtcgtttgaggcagatctgcattgccgtctactcggcttggaacgatagacagaggaagacacaagtgcgaggaaggggaaagggaggaaaacagcgaaagaggaggaaagaagagtacggcacaatgtgcgagcgaagcgagaagtgagtgagagtgtttagaagaacaaagtgagaaacgaaaatgaaacttctgggtatccttccctcaagcgactgttcgtggacaaacgcagttttcactcgagacgtcaacgcgttccgtctccattgcttgtctcctcgcgaccgtgttgtttttcctttcacaggttgcgtgcttcggagccagcaaacatgaggctttcctcaaggctctcatctcggctggtgtgccgctgcctcttgagaagcgaacgattctcatcagcgcaggtacgcaacgttctgtaaactaagcgattctttctgttcgctttctctctgtcgagcgacagcaactttttcctgtctccttccctccctctcgagacagagcagcttccatgttccccttagtgctttttaacagccgcgtttctctgaagtcggcgcatgcatctactattgcagatttcgcttcgtgttcgtgcgagccgaagaaatgctgcccgtcgccctggcccttcgactctctctcctcgtcagtttcgctctctccatttccagctggcgaagagtttctgtggacatatatctgtcgctcgcgcgtgatgcatgcactgcctctcggttgtgacattttatcctcttgtctttgcaggccctctgtggtcgaagatggaactcgagccgtacttcaaaatccttttggacctgggcttcacaatctacgcaacggaaggtaagtggaggcgcactccatgaatccctttgcagttctctcttctttttcttctcacactaacagttggtgttcctatctatctacctacctctctatctatgtctctctggttgtctgtctgcctctcggtccgtgtatctgtgtatctgtcggtgtagctctctaagccgcgaacggtcgtgcgtatatatatgttcatctgcaacacaacgaacgctctgtatgcacgtgccatgtcgatatgactgtgtacgctggccgtcgttgtctgtgtgcaggtgtattgcttcgccgctgcagaacgtagcatatgtgtatttattcaacattttgaagggatattgccttcggtttctttcagtggcatttagctaggattttttccttttttttgaaaggtagtgaagaacgtgtgttgacggccagggccgcagcacatgctgcgatgtctttcttttgcccatggtgtgtgtgtgtgtcttgtgtggtcgctttggcttttcttcattggactgtttttctttttgtgtttcttccatttttccgttcttcaagtgcatgcgaaggctgttaagcgtattctctcggaattggctttcacaaagctcttctgccccgctcctcgtttgtttccacttttcggcttctttttgttcaacgttcgcatgctcacacgcatgcacgcctcgattttttcctgtcctgacgcagacaagtgctcttcgttttactgctgtccccgtttccgctgccccgccgtgacttctctcgctttgcgagctcacgtttcttatttcttcgtttttctgaattttcttcggtgcccaggtacctacagattcctcatgaacagcgtcgttcgcgggcaggggacccacctgcctgggaacgcgtcgccggcgtccgacagcggccttcggactcctacgacagccgagtccgacgcagatgcgtgcatttgcgctaaatacgcatcgcgcattattcgcgtgagaaagccgattgtcggatcgaatgagtcgcacaacggaggtcaccagtcacctcacgctctctccctcattgaaagtggtaaggcccggcagtgagtgttcgggtggctgtgcagacggggcatgcgattttttgcgtttctgagcaacgaggcgccagcatgtacacacagcccagtggtttatgtcttgtttgctttcatgttgcagtcgcacatgcatgcactcttatgtgtatgcgcatctatcgtgccaaggtgtattcacatgcctagttatgtgcatgcggaggttgagatgcatactgaggatggtcgatgtttaaacgattgttcacaggctcagctattgggagcgagcatggtttttctctgtgagagttcactggaccctagacggtaaacactttcagagactggctggaccccctcgatcgaaaccatgcatgcagcagtcaagtggaccacagacagaaacagacacacagcagtgccacggagatgtaggtgcggcgttcacggaggtagaggtgaacatgtggtttcacatggcgttttgaatcttttcgcaagaaggaaagtacgcgtacttcctgctatgcacgaatcgctcatcctttcttgccgaagaacgaaacggtgtcttgtttgttcacatagggaaggtcgaaatggtcatcaatgtgcctgacagcatgaaccaccgagcggccacaaacggctacctgatgcgtcgcactgcgaccgactgcggaggtgcgtcttgcctcagtgggcgcaacagacgaaccaaagaaacgaaagaaaagacagaaaaaaatggtggaactcgtgctctagcaaaacggactacccgacggaactgcagagcgtctgtctggtccgagggcgtcttgccgttcccgactgggcgttcgaaaaaagcaagtcttctccatttcatgttttggcggcccgcgcgagcaacagtaatcttcactggcttggcccaccgactctcaagacctcagttctgtatgcgggcgcggggaaccaagtgcgaaatactcgttttctacataattatatatatatatatatatatgtatatacgcgtacatagatataaatacggacatgtagacagatgtatgcatacgcatatttagttacaaacgtgtatagatttagacagattcgtaatattttgtgtatgtttcgatcaatacattaacgtttcgcttgcaatcagatgcgtcgatggcctcaacagtcgacagagcatggggtacgctgttttctggggtcgggaacgtttcagaaatctcgtcacagagagcgggcttctccgcgccattggcttttgcgagactgtctgcagtatgttgatcggcgtttacgtcgttttcttgtttttctcttcgcagttcccctcctgacaaacgtcaaagtggcaagcatgttcgtcgaggccctcaacaagaaagaagcgaaagaagctcagggtcgctccttctgggacattcgcagctgggatgaatactggcctcaaaaataatttccaatgctttcgccaaaaacgttccatatctctcgctctactgacgcatttgagttacgcgacggatttccagcagtggctccgctgtatgcttcttcctctctctctaggcataatgatatatatatatatatatatatatatatatgcatatgtatgtgtacgtgtgtgggaacaccggcttgagaaccggttttcaagacgttgaaagtcgtctcatctttgttcctccacaactgagcatttgtctgtgtagatgcgcggctttgttcacatgtgtatcgacatctcagctgttacgtgtgctgatgtgaatagagcagcgagcgtacaagtagtgaatttgcctcagggtcttttggcgacggttggtgttgtcgaagcaacgcgcttgcagttgtgtgcatgcttgagccgatttgaaccaacaacctatttgtgcggtgccagtgttctgcaaagagagcgtcacgtcgggaatgcttcaaagccgaaacaaatggcatcgaaactctcgtcggatgcgagacatgcctgcacctcctgccgtcgcattccatttcgaaggaaagtcatcgcctcggacgccgagttctgattcacggaaaatatgcagactgtggcgtaaccattctctcagaagaaacacagatttctacaactcgaacttcgccttcttccataaacgtttcgtcaacatatttatacatacatagagatatacgtgtataagtaaa

SEQ ID NO: 4618 - protein, 490 aa, homo sapiens
MTASSGWEPAPAATMASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 4619 - DNA, 2280 bp, homo sapiens
gaggagaaagtagagaatgatgcctccgcaccctgtgaacttccaacaagggaaggtgacatgaaaggagctcagacaatttctgtccagcaacatgacagcaagctcaggctgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4620 - protein, 476 aa, homo sapiens; identical to SEQ ID NO: 4610

SEQ ID NO: 4621 - DNA, 4618 bp, homo sapiens
cggccgcggcgccgacggcggcgggaagggcggacggggcgggcctccctggtggcacggggccggagcaggccgggagcaggtggcgggcacagcttgcgggccaggcacccgaacttgcgacaagttgccggagccgcggggcgcgggcggcggacagattgaccttcagagcgagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggccgggagcaggtggcgggcacagcttgcgggccaggcacccgaacttgcgacaagttgccggagccgcggggcgcgggcggcggacagattgaccttcagagcgagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4622 - protein, 476 aa, homo sapiens; identical to SEQ ID NO: 4610

SEQ ID NO: 4623 - DNA, 2364 bp, homo sapiens
ggccgggcgggcatgggccttcccggcccggagctgggagtcgaaggggcgggaggcgtgatggtgaactcgcaagaagtttgagggacgcgcgggccccgcgcccactccccctccaccggacacggctggggccggcgatgcctgagagggggtcggaggacgcagtgaacatatatgcatgtacagtgtggatcctcatctgagaggagggagatgaaaacacacccacctcacaggctgttgtgaggactaagggtgcggcagtgcctggtacatgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgtaaaaaaaaaaa

SEQ ID NO: 4624 - protein, 391 aa, homo sapiens
MASRIGLRMQLMREQAQQEEQRERMQQQAVMHYMQQQQQQQQQQLGGPPTPAINTPVHFQSPPPVPGEVLKLDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 4625 - DNA, 2089 bp, homo sapiens
cggccgcggcgccgacggcggcgggaagggcggacggggcgggcctccctggtggcacggggccggagcaggccgggagcaggtggcgggcacagcttgcgggccaggcacccgaacttgcgacaagttgccggagccgcggggcgcgggcggcggacagattgaccttcagagcgagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa
